United States Patent 7,867,704 (MYCOBACTERIAL DIAGNOSTICS) - sequence listing, part 2

SEQ ID NO: 1355 - DNA, 4830849 bp, Mycobacterium paratuberculosis (residues 1,610,284-3,220,566 of 4,830,849)
  misc_feature (1)...(4830849): n = A,T,C or G
ggctgacctggatcatgccccgggattcctggctgctggatcgcgcgacgatgcagcccggcgcgttgttcgccgagcagatcaaacacagcttcactgcccagctgcgcgccatcaacgacgccggttcggtggccgagctgttttcccggctcgaggacgccggcctgctgctgcgcatcgatccggcggtgcggcccaccatgtaccgctgcgcgaccgtcacccggctcgaactcgagcagctgcgccggatcaccgacgtggtgcggctgggccacgtgcgctccatcgagccgggcgcgatggtgctggacggcggcgccgtcgcggtcgacggtcgcgcgctctacctggactgcaccgccgatggcgccgaaaagcggccagccacaccgattttcacacccgggcgaatcacgctgcaaagcgtgcgcggctgtcagcagattttctccgccgcgctgatcgcccacgtggaggccggctacggcgacgacgcgcgccgaaacgagctctgcgtgcccctgccgcaccccgacaccgacgtcgactggctgcggctggcgctggccgactacaccaatcagctgcgctggttcgacgacccggagttgatgacgtggttgtccggcgcgcggctggatttgtccgggcatctgatcggccacctgctgccgtcggcgtcggccaaaccccgggtgcgggcgcggatcctgggcatcgccaagtcggtgttcgcggccaccgccgccaggctgggcgagctgctagctgccgacgccgcactcgccgcgagctgacccgtgtaacccgagccgatacttcatagcggtgaaggaggcaggtggcggcacacaacgaacccgtcggcccgcgaccgctgcgcgcggtgcccgagggcggctacccggactgggaagccgtctacgccgacaacgcggcctgggtgtatcgcacgctgttcgcccgggtcggcaaccgggccgacgccgaggacctcaccgccgaggtcttcctggccgcgttgcggccgctgcggctgaccgccagcgccgccgaggtgcgcgcctacctgcgcgccaccgcccgcacggtgctggccgcgcactggcgcgagacgctggggcgggagataacctcgatcgaggacatcgaacaaccgcccgagcaccccgacgcgatcagcaccgccccgcagcgcgtcgcccgggtgctggacagcctgccggaccgctatcgccgcatcctggaatcgcgcttcctgcaaggtaattcgatcaaggaggcagccgcggaactgggaatcagcgtggccaacgccaaggtgctgcagcaccgcgcgctgcggctggcggcacaggtcaacgagggaggccggccatgaacgcgcgagggctgcggcgctacgtcgacgacctgttgcggggccgccggccccggccgttcctgcccgacgatttcgaggcggcccagctgcgcaccgcgatcgagctgcgggcggcccggccggactccgaagtggccgacgcgccgcgcccggaattcctcgccgatctgcaccggcggctggccgagcagatgtccggcgcgccgacccgaccgcggcccgggcgcggcagcacccgccgccaggtgatcgtcggcacctcggcggccgccaccgccgcggtcgccgcggtgtccatcgaccgcaccgtgatcgcggggcagtccggcccggatcgcgccccgcagatcgcgtccgggacgctggcccccaaccagggcagctggcagcgggtcgcggccagctcggaggtgcccgacggcgtcctgcgcgccttcgacctgggcgcggtgagcgggttcgtccgccgcgtcgacggcaaggtgcaggcgatatccggggtgtgcacgcatcagggatgcaagctgtggttcgacgcgcccgacgacacgctgcgctgcccctgccacaccacgtcgttctcgcccagcggaaaggtgctcacccaccagctgccgatcgagccgaaaccgttgccggcgttgatggttcgcgaggccgacggcatcatcgaggtgttcgccccggtgcgccgcatctgagccgtgtaacccgcggccctatctgtgggcatgacccttgcaaaatcgttgaccgcggcgctggccgtcgccgtggcggtggccgcctgctcggctccgcggcccgccgcgggcggcggcacgcccagcacccagacgccggtcaccgcgccgccggcggcggccggccccaatcaggtcgtcatcgacggcttcgcgttcgcgccggccaccctgaccgtgcccgccggcaccaccgtcacctggatcaaccgcgacgaggaacctcacacggtggccgcgagcgacgggtcgttccactcaccgggcatgggcaccggggccgtcttcacccacaccttctccgccgcgggcactttcgactacgtctgctcgattcacccgatgatgcgcggcacggtggtggtgacgggatgaatccgaacatgagccgccggcagttgatccggcacacggcgtggttcggggcggcggtggggttcgccctgaccgggggcgaggtgatctcccacgtcgccggccgggcggccgcacagcacacccgcgcccagcccaccctgcggttcgcccagatcagcgacagccacctcggtttcaccggcgcccccaaccccgacgtggcgggcacgttcggccgggccatcgaccaggtcaacaacctgggctacaccccggatttcgtcatccacaccggcgacctcacccacctgtccacccccgagcagttcgaccaggccaagcagatgatgagcgcgctgaagaccccgcacgtgttcaccgtgcccggcgagcacgattcggtcgacgacgcggggcagaagtaccgcagcgtcttcggggcgggttcggccggtgacggctggtacagcctcgacgtggccggtgtgcacctgatcgcgctggtcaacacgctgaatctgcgcaagctcgggcacctgggcgccgaccagttggagttcgtcaaaaaggacgtcgccggcctgtccagcgacactcccatcatcgtgttcagccacatcccgttgttcgcgatgtacccgcaatggggttggggcaccgacgacgccgcgcaggcactgagttatctgcgccggttcgcctccgtcacctgcctcaacggccatgtgcaccaactgttctccaaaaccgaggacaacgtgacctttcacagcggcaccaccaccgcctacccgctcccgcacccgggcgacaggccggcacccaagccggtcaccctgcccgccggcaggctgcgcgacgcgctgggcgtgcgcgaggttgcctacagccggggcgacaccgttctggcactgaaagagcggaccctgcaatgactttgacgacaatagccactcggctcggcatcgccgcgtcgttgacggtcagcgcgctcagccacgcctacctgtatgtgcatggctaccaacacattccgggcatcggggtcgcgttcctggtgcaggccagcgtgtcgttcgccgtcgcgctgctgatctgcgccggcgggccgggctggctgagctgggccggcgccgcggtggccggcggctcgctggcagcgttcgcggcgtcacgtacggtcgggctgttcggcttcgccgagcggggctgggatccggcgccgtacgcggcgatcagcgtggccgccgaggtgctcaccgtgctgctgtggttgccggatgtccgcgttcggcggtggtggccgcagaccacttccggcgcagccggcgtttgagcgccatcgacggcttttcgatcaaccaccagctggccgcggccagcggcagggtggcggccagggcggtcaggaagaacaccgccaccggcagccggggcgagcccgcacaccgccagcagctgctggaccggaaacgcgtagatgtagacgccgtaggacaggtcggtggccagccgcagccggcggttgcgcagcagggcgccggacacgatgatcgcgtaggccagcggcagcgcggccaccacccggtagtcgggcagccggctggccgccgccacgacgacgacgcacaccgcgacgagcgaccaccgggccgggatcacgtccttccactggtagaccacggccccggcggcgaacatgatggccgagcgcaccgccagctgcgcgacggtccattgccccgggtaggtcagcggtggcaccaacgccgccccgaccaccgccagcgccaacaccgcgacggacatccaccggcgatcggccagcccggccacgccgatcgcggcgacggcgaggtagcacgccacctcccagaccagggaccacaacgagccgttccagacccccggatgcggtacgccgccgggtgttgcgccgatgttcaggtggacgtaggccaccgcgctgttcttcgcgaggtactccagcggcgcgccggaggacagcagcgcgcccaccgagcccccctggatcgccacgctgagcggggcgaccgcgaacgcggtgacgatcaggcacacgtagtagccgggcaggatacgcagggccctcgcggcgagaaagtcgcgcagtcgcggatcgtcgagccagctgcgggtgatcaggaaccccgagatcgcgaagaacccgtccaccccgaccgagaagagaagctgcagcgtcgccgccggcggcagccggttggtgatcggccagcaatgccacagcatcacctcggccgccagcagcagccgccacgcattcagcgcgttgcgccgcggatcgaacaccggcccgagggtcatcggcctccgcctgtcctatgccccccgcactatggacgccccccgcactggggcggcatattaccggcaccggccgagccgcggctagaagtgtcccggcgcctccggggccgggcggtcggcgagcacgtcggccggggcgggctcggcctgcgacacccgcgggtcgctttcggcggcccgcgggccggtccacttgcgcttgaggcggcgtttgagggccatcgacggcttctcgatgaggaaccagctggccgctgccagcggcagcgtggccgccaccgaggcgaggaagaacagggccggatgcaaccgcgtcgccagcccgcacacggccagcagctgctgggtggggaaggcgtagatgtagacgccgtaggacaggtcggtgcgcagcaccaaccgctcgctcttgagcagggaaccggtcacgatgacggcgtaggccagcgggagggcaccgaccacccggtagtcgggcaggaacccggccgcggcgacgatggcgagggcgaccgcgaccagcgaccagcgggcggggatgacgtctcgccactgatacatgaccgccccggccgagaacatgatggccgagcggaccgcgagctgcgggatggtccacactccgggaaatgtcagcggcggcacgaccaatgcccccaacgtggccagcaccagaatcaacggggaaatccagcgacggttgcccagccccaccacgccgatggcggcgacgacgaggtagcagagcagttcccagatcaacgaccacatggaaccgttccaggcgtttccgcccggcaccccgtgcagcgttccgtcgatgctcggctgcagatagacgatcgcgctgtttttcaggatgtactcgagcggggcggcggacccgagcagcttggcgggcgacccaccctggatcaccacactaagcggggcgaacacgaacgccgtcacgatcaggcagatatagaagcccggcaggatgcgcagggcgcgggcggtcagatagtcacgcagccgggggtcgctgagccagctgcgggtgatcaggaaaccggagatcgcgaagaacccgtccacacccaccgagaagaacagctgcaggatggacttgggcggcatgtgaccggtgatcggccaggagtggaacagcatcacctcggcggccagcaccagccgaagcgcgttgagcgcgtttcgccgcggatcgaatacctgcccgagcttcatccgcctccgtttccgtgcccaccgcgcgccgtcggcgccatcgtatcggccgaaggcggcgagcaggggacgcgggcgacggggtggtgcccggccgcgccgctacgccacacccgggacctcgggcggcagcaccatcgccgcctgctcgggggtggcggcggccttccttttcaaccgtgtcttcagcgcgcgggccggcttctccaccaggaaccagctcgccgcggccagcggcacggtggccgcggcgacggccaggcagaacaccaccgggttgaggctgagcagcccgagcacggccagcagctgctgcaccgggtaggcgtagatgtacatgccgtaggacaggtcggtgcgaaaccacaaccgccggttgtgcagcagggagccggacacgacgacggcgtaggccagcggaagggcggccaccacccggtagtcgggcagctggccggcgaccagcacgatgaccacgcacaccgccaccagcgaccagcgggccggaatgacgtcgcgccactggtacagcagcgcgcccgccgagaacatgatggccgcccggcaggccaggaagaccagggcggtcgcgacgttgccctccgggtggtggaacacctcggggaaggtgaccggcggcaggaacgacgccccgatcgccgccgccaccagaatcaccggggacacccagcggcggttggcgagtccggccacaccgatcgcggccacgaccaggtagcacatcacctcccagaacagcgaccacagcgaggcgttccagatgcccgcgttggggatgtcgtgcggggtgcccccgacgtcgggtttgagccacaacaccgcgatgttcttcagcacgtactcgaacggcgcgtaggagaacaacagccgggccggcgacccgccctggatcgccacgctgagcggggcgaagacgaacgcggtcacgatcatgcagacgtagaagccgggcaggatgcgcagcgcgcgggcggccaggtaggcccgcagctgcgggttgctcagccagctcgcggtgatcaggaagcccgagatcgcgaagaacccgtcgacgccgacgcagagcaacagctgcaggacggcccgcaccgacgggaggtgaccgcggatcggaaaggtgtgccagaagatgacctcggccgcgagcgccaaccgccacgcgttgagtgcgttgctgcgcgggtcgaacacctgcccgagtttcatcgacgtttcccgtcatccgaaacgggcatcatcggcatcatcggcgccatcctaacgtcaccgaacgccgaattgggccggttcacgctactgggccgatcagggcgctgcaaccgcggcgttacttgatatgtgttgaataaaacggtcgggtggcgatcccgggttgtgcgcacggcgagcgccaactgcgttgcgggataacggttgcgggcaatgcgggtcgagacgatcagcgcggcaaaccctcgatgaatgcttgcgtctccgcccaggtgggcagcaaccccgaggcgcgaacctcctccaggctgggggccgcggcgtcgcgctcggacagcgtgggcgcggcgccggccaccagcggccagtcgatccccaacgcgggatcggtggcgcagatggtgtgttcgcgccccgggttgtattccgccgagcacaggtacatcaccgtcgaattgtcttgcagcgcaaggaatccgtgccccagaccctcggagatgtagatcgtgcggtgctcggcgtcgtcgagcagcaccgaatcccattgcccgaacgtgggcgagcccacccggatgtcgacgaccacgtcgaacaccgaaccacgcacgcaggtcacgtatttggcctggctgagcggcacctgggcgaagtgcaggccgcgcagcacacccgccgcggacaccgagcagttggcttgccggacgtcgagccgatgaccggcgaaggagcgaaaccccttgtcggtcagccattcaaagaaatggccgcgggcatcgccgtgcacggtgggggtgatctcccaggcgccggggactttcagttcgcgggccgacacgtcactgcccgcgttcttcgtagcgcgcttccgaggcgtctttcaacggccgccaccacgattcgttcgcgcgataccagtcgatggtctcacgcaggccctcctcgaagtcggtgtgctttggcgcccaacataattcgtcgtacagcgtggacgggtcgatagcgtagcgcaggtcgtgtccgacgcggtcggtgacgtggtcgaagtcgtcggggtcgcgccccatcatctgcagcaacgtccgcagcacggtcaggttgtcgcgttcaccctccgagctgatcaggtaggtgcggccgatctcgccggattccaggatgcggcgcaccgcgctgttgtggtcgtcgacgtggatccagtcgcgcacgttggcgccggtgccgtacaacttggggcggcggccggtgagcacgttggtgatctggcgcgggatgaacttctcgacgtgctgatacgggccgtagttgttggagcagttggagattgtcgcgcgcaccccgtacgagcgcacccaggcgcgcaccagcatgtcggcggccgccttggtggccgagtacgggctggacgggttgtacggcgtcgactcggtgaaccggttcgggtcgtcgagctcgaggtcgccgtacacctcgtcggtggagatgtggtgcagccgcacgccgtgacgccgcaccgcctccaggatggtgaaggtgcccaccacgttggtgtgcaggaacggctccgggccggccagcgcgttgtcgacgtggctctcggcggcgaagtgcaccacggcgtcggactcggcgaccagccgcgacaccagctcggcgtcggtgatgtcgccgaccaccagccggatggaatcctcgacgccggccagcgactcgcgccggcccgcgtaggtcagggcgtcgagcaccgtcaccgagtcctcgggatgctcgcgaacggtgctgtgcacgaagttggcgccgatgaatcccgcgccgccggtgaccagtaaccgcatgacccaaaccctaacggagccgatcggtcagttcgtccgagtcagccccagagcatcggccaattcggtcagcgcgggcagcagcgtctcctcggaatccccgcccagcacctggatcgccacgtggtcggccccggcgtccagatgctcgcgcagtcgcgccgcgacggcctgcggggtgccgtagctgatcaccgcgtcgatcagccggtcgctgcccggtgggcgcacgtcggcctcggtgaaccccagccgcagccagttgtgcacgtaattgctcaggcccaggttgtgctcgatggcctgccggccggctgcccgcgcccggtcccggtcggtggtgagcacgaccttgtgcgcgggcgccaaaaagaccgagccgcccaccaattcgcgcgccttggcggtgtgttccggggtggtcaggaaggggtgcgcgccggcgctgcgctgagcggccagccgcagcatccgcggtcccagcgcggccagcacccgccggctggtcgggatcaccgccgcgtcgagctcgtcgaggtaggagaccaccgcgtcgtacggcttgacgtattcccgggtgtgctcgcggtggccggccccgatgcccagcaaaaaccttccggggtggccgctttcgatccggtggaacgactcggcgacggccgcggccggcgccgaccagatgttgacgatcccggtggccaggtgcagcgaggtggtgccggccagggcggggtccacccaggacagctcggcgtcgggtgatccgccgatccaggcggcgccgtagcccagcgatttgatccgcgcggccagttcggcggtgatggaccgggtggacagccacacgccgaacgggcccaggtcgggcttgagcgaaactccctcagtcatccggctccccctgtggtcaggacggtttcagtccgagcggccccgccagttcggccagcgccgagaccaggttttcatccttggtcagcacctgcacgggcacgtggtcggcgccggcgtccagatgctcgcgcagccgcgcggcgatccggtccacgctgccatatgccaccagcgcgtcgaccaagcggtcgctgcccggccgggtgatctcgtcgtcggtgaaacccagccgcttccagttgtttcggtagttcgcgaggttgaagtagatgtcgagcgccttgcggccgaccgcccgggcgtgctccgcgtcggtggtcagcaccaccttgtgctcgggcgccaggaaggccgacgggccgatgagctcgcgggcccgggcggtgtgctcgggcgtggtcaggtacgggtgcgccccggcggagcgctcggcggacagcttgagcacccgcggccccagcgccgccaccacccggcggccgcccggcacgccgtactcgtcgagccgggtcaggtagtcggccagcgcgtcgtagggcttgcggtattcggtgtgcgcctcgggatgcccgacgccgatgcccagcaggaagcggcccgggtaggccgcctcgatccggtggaaggattcggccaccggcccggcgggcgcggtccagatgttgacgatgccggtggccacctgcagcgtcgtcgtcgcctccagaaggggctccacccaggccagctcggcgggcggggaaccgcccacccagacggcgccgtagccgagcgcctcgatgtccttggcttgctggggtgtgacgccgcgtccgaacgatccgaaccggccgagatcgggcttgcctgctgcttgggtcatggtcgtggcaaccggcgtccgcgggccgctattccggcccccgccggccgggggtctgcgctcgtcaggaggattttggtggcggccgaaaaccaggtatcgtagaacgacggtgcggcatccgcgccgactttttgtgtgtccagtcctaggaatttcctgtcaccggctcacgttccaagtcggtgtgcaatggtgcgccgacctgggcgcatacccgaacgagactaaacgacgaggatttttaaccagttatggccaagaaggacggcgccatagaggtcgagggccgcgtggtcgagcccctgcccaatgcgatgtttcgcattgagctggagaacggtcacaaggtgcttgcccacatcagcggcaagatgcggcagcattacatccgcatcctgcccgaggaccgggtggtcgtggagttgtctccgtacgacctgtcccggggccgcatcgtgtaccgctacaagtaacgacacagaacaggatcgaacagccgtgaaggtcaacccgagcgtcaagccaatctgtgacaagtgcagggtgatccgtcggcatgggcgggtcatggtgatctgctccgatccgcgccacaagcagcgacaaggctgagccgcggccgggttcgcccggcccccgacacaactgaatgcagacctcccagcaccaccgagctgcctggcgcgtcaagcgccaaaaaagacgaatcagcgccgctcggacacgcccggacggaggccgggccccgcaaatcccccaggggaaccgggaacgggctgggatcagacctccgcagagaaaaagaggaacgccacccatggctcgactagtcggcgtcgatctgccgcgcgataagcggatggagatcgccctgacctacatctacggtgtcggccgcacccggtcgaacgagatcctggcggccaccggcatcgaccgggacctgcgcacccgcgatctcaccgatgaccagctgacccacctgcgcgattacatcgaggccaacctcaaggtcgagggtgacctgcgccgcgaggtccaggccgacatccggcgcaagatcgagatcggctgctaccagggcctgcggcaccgccgcggcctgccggtgcgcggccagcggaccaagaccaacgcgcgcacccgcaagggccccaagcgcaccatcgccggcaagaagaaggccaggtaaccacccatgccaccagccaagaaggcagccgctgcccccaagaaggggcagaagacccgccgccgggagaagaagaacgtcccgcacggcgcggcccacatcaagagcacgttcaacaacacgatcgtgacgatcaccgacccgcagggcaacgtcatcgcctgggcgtcgtccggtcacgtcgggttcaagggctcgcggaagtcgaccccgttcgccgcccagctggccgccgagaacgcggcccgcaaggcgcaggaacacggcgtgcgcaaggtcgacgtgttcgtcaagggcccgggctcgggccgggagacggcgatccggtcgctgcaggccgccgggctggaggtcggcgcgatctccgacgtcaccccccagccgcacaacggcgtccgccccccgaagcgcagaagggtctagcagaatcatggctcgttacaccggacccgtcacccgcaagtcgcgccggctgcgcaccgacctcgtcggtggcgaccaggcgttcgagaagcgcccctacccgcccggccagcacggccgcgcgcggatcaaggagagcgaatacctgctgcagctgcaggagaagcagaaggcccgcttcacctacggcgtgatggaaaagcagttccgccgctactacgaggaggccgtccgccagcccggcaagacgggtgaggagttgctgcggatcctggaaagccgcctggacaacgtcgtctaccgggccggcctggcccgcacccgccggatggcgcgccagctggtcacccacggccacttcacggtcaacggcgtgcgcgtcgacgtgcccagctatcgggtgtcgcagtacgacatcatcgacgttcgcgagcagtcgctgaactcggtgccgttccagatcgcgcgggagaccgcgggcgaccggcccgtcccgagctggctgcaggtggtgggggagcggcagcgcatcctcatccaccagctgcccgagcgggcgcagatcgacgtgccgctcaccgagcagctgatcgtcgagttctactcgaagtaagaacccctgcgctgaacccggcgcagggtacttagcggcatcaaatagcgggtgccgagaaggagaagaagaaacaccatgctgatctctcagcgacccaccctgtcggaggaagtcctcaccgacaaccgctcccagttcgtcatcgagccgctggagccgggattcggctacaccctgggcaattcgttgcgccgcacgctgctgtcctcgatcccgggggcggccgtcaccagcatccgcatcgacggcgtgctgcacgagttcaccaccgtgcccggcgtcaaggaagacgtcaccgcgatcatcctgaacctcaagagcctggtggtgtcctcggaggaggacgagccggtcaccatgtatctgcgcaagcagggtcccggcgaggtcaccgcgggtgacatcgtgccgcccgccggcgtcaccgtgcacaaccccgagctgcacatcgccacgctgaacgacaagggcaagctcgaggtggagctggtcgtcgagcgcggccgcggctacgtgccggccgtgcagaaccgcgcctcgggcgccgaaatcggccgtatcccagtcgattccatctactcgccggtgctcaaggtcacctacaaggtggacgccacccgtgtcgagcaacgcaccgacttcgacaagctgatcctggacgtggagaccaagagctcgatcacgccgcgcgacgcgctggcgtcggcgggtaagaccctggtcgaattgttcggcctggcacgcgaactcaacgtcgaggccgagggcatcgagatcgggccgtcgccggccgaggccgaccacatcgcgtcgttcgcgctgccgatcgacgacctggacctgacggtgcggtcctacaactgcctcaagcgcgagggtgtgcacaccgtcggcgagctggtcagccgcaccgagtccgacctgctcgacatccgcaacttcggccagaagtccatcgacgaggtgaaggtcaagctgcaccagctgggcctgtcgctcaaggacagcccgccgagcttcgacccgtcgcaggtcgcgggttacgacgtcgccaccggcacctggtccaccgaggccgcctacgacgaccaggactacgcggaaaccgaacagctgtaacacggctttgacctaaggagcgtcagcaatgcccaagcccaccaaggggcctcgcctcggcgggtcgtcttcgcaccagaaggcccttctggccaacctggcgacctcgctgttcgagcacggccggatcaagacgaccgagcccaaggcgcgtgcgctgcgtccgtatgcggagaagctgatcacgcacgcgaaaaagggtgcgctgcacaaccgccgcgaggtgctcaagaagatccgcgacaaggacgtggtgcacgtcctgttcgaggagatcggcccgttcttcgccgaccgcaacggcggctacacccgcatcatcaaggtcgagccgcgcaagggcgacaactctccgatggccgtgatcgagctggtgcgggagaagacggtgacctcggaggccgaccgggcgcgccgggtgaaggcctcgaagaaggccccggaggccgcggcggcggcgccgcaggcggcggtcgagcccgaagcggccgaggccgcgccggcgccggacgcaccggaagctgcgccggaagcggaggccgcggcgccgcggccggcggacgaggccgaagggtccagcgaggattagcgaggacgtccgtctgcggctcgatatcgcctatgacggaacaggtttcgcgggctgggctactcagtccggccagcggaccgtggccggggtgctcgacgaggcgctgacgaccgtcttccgcacgccggtgcggttgcgcgccgcgggccgtaccgacgcgggggtgcacgccaccgggcaggtcgctcatctcgacgtgccgggcaccgcgctgccgaacgcctatccgcgcgcaccgcacgtcggcgaagccgaattcgggccgctgctgcgccggctgggccggttcctgcccaccgacgtccgcgtcgtcgacatcacccgcgcgccagcgggtttcgacgcccggttctcggcgctgcggcgccactacgtctaccggctctcgacggccccgtggggtgtgctgccgcagcaggctcgctacgtcaccgcctggccccgccccctggatgtcgaggcgatggccgccgcgtcgcgagacctgttggggctgcacgacttcgccgcgttctgccgtcaccgcgagaacgccaccaccatccgcgacctgcagcgcctggactggacccgcgacggcgacctgatcaccgcgagggtcagcgccgacgcgttctgctggtcgatggtgcgctccctggtgggggcgctgctggcggtcggggagaaccggcggccggtgtcctggtgtcgcgaattgctcagcgccacaaaccgatccagtgactacgccaccgcaccggcgcacgggctgaccctggtcggggtcgactacccgccggatgaccagctggcggcgcgcaacctgatcacccgcgacgtgcgctcgcgctagacccgggtggcgacgaacctggctgcctggttggtcaatccgggcacatagctcaggtgcgacgcccactggtaaccgcccgagcagatcgggtcgcccgggttgcacaggtcgatggtcttgccgctgaaatccggggtcagggcgctcatcaggcggccggcccggcccgacggattcccgaacagggcgacggcggcgacgtgatcggcggcctgcggcggcaacgggttgcgaaagcccaggcccggcaccggtgcggcggtgacgatgtcgatgacggcggcgccctgcgaatacccgcccagcaccagtttggtgttcgggcagttgccggccatctgctggatgtggttgctggcgtcgttggcgccgtccgcggcggccaggaagtccttgttcgccgggtagttcaccccgtatgcgccaacgcttttgcgggtctgctcacgcaacgagctgacgaacgcgccgcccaccttcccaaccccgggcggctcgtccgtgccccgggcgaacaccacttcaacgcccggacacgatgccgacgcgagcggaatcaattggggggcaatcaaaaccgctgcgcccgcgagcagcccgacgcccagccccacagggataagcctcacacagcgatgttaggggcgcgttggtcgcgggccggtaacgattcagacgagaggtgcttgcgaaggcggcgtgctcggcacggccggggccggcgccgtgccggggccgggggcgttgtcgtggatcgagggacccgaacccggcggggtctggccgtacaccggtgactgctggccgtagccgggcgactgcgggcccacacccggcaccgacggcccgtagccgggcaccgactggcccgcgcccatcagcttggaggcgacgaacgccgccgcctgcgtggtgtacacggggacatagccctcggtgtgcccgctccactcgttgccggggccggcgtggcagatcgggtcgttggggttgcacaggtcgatggccttggagcccagcagcgcgctctggctgggcagcgtgccgccggcgcggtcggcgacgtcgccgaacgtggccacggccgcgacgtgactggccagatccggggtgatcgagctgccccagttgatgccgccgatgggcacgccggccacgatgtccatcaccgaggcgccctgcgagtagccgcccaacacgatcttggtgttggggcacttctgcaccgcttgcttgatccggttgatggtgtcgttggcgccgtcgccgccgtgcagctgcagcttgctggcggcatagttgaccccgtaggtgtcgatgttcaacccactggtctgctggcgcagcgattcgacgaaggcgtcgccgacccggcccatgccggggggctcgttggtgccgcgggcgaagatgacctcgacgtcggggcaatcgtcggcggaggccaccgggaccgcggccggggcgccgagcaggccggcggcggtgatcagcgccgatgagcccagaccgaggagtcggccgatccggtgagttttcaccgggcaattttacccaaatcgcggcccggcgaaactcccgcgacctgtggataaccgcttcggcggcgccgcccggcggcctagcgtgtgcgcaacggattcgcggggaaggggagcagtgccgcgtcggcccaccacgtggctgcaggtcagcgcgtaccggtacctgtcgcgccggctggaatgcgcgttgctgggccaggacccggccgcggccggcatgcgtgcccgcggccagcccgcggcgctgttggcgggggcggtgctgacggcggccgcgctggccgcagcgacgttgctgggtttgctgcgcccgcacgtcgcgctggacggggcgcgggtcgtgctggcccgggattccggtgccctgttcgtccgggtcggcgacacctggcatccggtgctcaacctggcctcggcgcggctcatcgccgcgtcggccgtcgatccgctcaccatccgccaggccgacctggacggcagcaaacgcggtccgctgctgggcattccgggcgcgcccgcgttcctcggccggccgctggcagcggcggagtcgttgtgcgacagcgacggcgccggcgcaaccacgatcctgctcggccgcacggacgccgcctcgatgcgcgtgctgggcggcgggcaggccatgctggtcgcggctgccgcgggttcgccggcctacctgctgcacgacgggcaccgggcccgggtggacctggccgacgccgcggtggtgcggacgctgcggcttgagggccgggcgccgcggctcgtctcgcagtcgttgctggacgccgtgccggaggcggcgccgatcgcggttccgcggatacccggcctgggcggcgcggcgccggggctgccgggattcgcgatcggcactgtgcttcgcatcatccgcgccgacggtgacgagtattacgcggtgctggccggcggcgtgcagcgcatcggccgggtggccgccgacctgctgcggctaagcaacccgcagggcagcgccgacgccgttaccgtcgcacccgacgcactgcgcaccgccccggtggtcgcggcgctgccggtggccggcttccccgaccgggcgccgaccgtgtcggagccggccgccacgatctgcgccggctggggagacgcccgatccgtcgcgttcctgaccggggcggcggttccggtgccgcccggtcgggcgccggtgaccctggcgcaggccgacggccgcggacccgcgctggacgcggtgtacctgccgcccggccgcagcgcctacgtacgggccggtgcgaacgccggcacccgctacctgatcaccgacaccggggtccggttcgccgtgcccgacgacgacgccgcggccgacctgggtctggggcagccgagcccggcgccgtggccgctgctcaccctgctgccggccgggccggagttgagcagaccgaacgcctcagtcgcccgcgacaccgtcgtgggtgcgccgtagccgggcccggaccgccccggcggccgcggcgagcgtcagcgcgacaaggcagaacgcggctccgcgcaccgcgacgtcccgggcgcgcgaatcacgggcgggcgccggcggcggggccgcgatcggcaccggcgcggctctgggggcgggcggcggcgcgcccgtctccgcgctgaccgcggcgagcgggtcgacggtgccgtgcccgaccaggggatcccacccggcgggcggatgatgcgccgtcgcctcgatgcgctgcatcacctggcgcgcggtcagcgcggggaagcgggcccggatcagcgcggccagcccgctcaccaccggggcggcatagctggtgccggacaccggttcgggcgccagcgacgtcaccgcttcgccgggcgccgcgacgtccacccacgggccggccaggctgaacgccgacggggctccgtcggcgttcaccgaaccgacggtcagcacgtagtcgtcgtaccaggcggggctgacggcgacggtgatcgtctgccaggtggcatccggctgctgcggcgggcactgccccgccccgccggtgttgccggcggcagccaccacgaccgcgttcttgacgtcgacggcgtaggccagcgcggcgcccagcgcccggtcgtcgggcgccgaggccaccggcgcgcaggccaccgaggagatgttgatcaccgacgcgcctagatcggccgcggtgcgaacggcttgggccagggtgtcgacgtcgccgaccccgccgcccgaccggttgccggcgggcccgaacttcgcgctggactggcggatgctgatcagcgtggcctccggtgcgatgccgctgaattcgtcggacttgggatcggctgcggcggcgatgattccggcgaccagcgtgccgtgcgcgtcgcagtcctggatgccgtcgccggtggacacgtagtcgccgccgggcaccaccccgggcagccggcggtgccgtgcgaccccggtgtcgatgaccgcgatgcgctggccggcgccgcggctgagctgccacaccgccgacaggtccgacccgcccgccgggccgcgcgggcccgggcccgagtcggccgtcagcgtcgcgcacacctcgcgctgcgcggtcggccacggcggcgccggccgcgccggcttcggcaaccacttgtcctcgacggccggcggcgaaaccgcgtgcgccggaggggtttcgaacaccggaagcatcgtcagcgccgaaaccgccagcagccgcacgaccctcacccgagcgtcaatccccgaaccgtgccgtacagcccggcgatccagcaggtgagcggcaccagggcggccagcgccagccactccagcaggtcggccgcccggctcagcaccggcgagcaggttcgcgccgcgcagccgaggtacagcgccgcggcgacgagggtcgccgtcgtcgccgccacccaggggccaggcagcggtgcgctccaggccgcgacaccgaatgtcgttgcggtggtgacgattgcaccggcggcgaagaccagagcccgggtgccgtcaccgccacgcgagcgcagcagcaacagcgcgccggtgccggttccgaacgccaggcagcacagccggggcgcgccggccagcacggtgacggcggcggcaacggtggccgacgacgacaacccggccagcaggccggtcaaccaccggtcggcgcggcgcgcgcgggcggacacccacgcctcgccgggctcgggaccgccggctgttgcggtggccggccggggcgacaaccccgccagtgcgagcgacgcgcgcgccgccatcccgagcaggcacagcgacaccagcccggccgccgaggcgacggtcggcagcggcgcgccgctgagcacgccggccagcgcggcggtggcgaggatcaggcaccagcaggcgagcgcgagcaacccggcgccgcagcaacccgacagcccgatcgccgacaccgcggcgaggcccgcggccgccgcggccagcaacacgtgggaaaggctcggcgcgccgggcaccgccacgaaaccggccagccccgcgaacacggtggcgatcgcgccgagcgccagggcggcgccccggtcccgatagccgcggtgcgcgaccgcggccgcccccagcgtcagcagggtggtcgataccagcaccgcgaccgtaccgccggaatcgcgaacaacgccggcgctgaacgtgtttcgcaccaacagcagcccgcccgccgtgacgaaggacgcggccgccgccgcgcccgcgacccgccggaccgcaacacccggccgggccgtcgcatcgagcgcggccgacacggtgtcggcgatgtcgcggtagcgcggtgcgggcagcggcacgtcgatccggctcagcaccaggatcgcgccgtcgccgatgtggttgtgcgccaacgttgtcgacggatccagcgcggcggcgcccgcggccgacaaccggtagcgcccggcgccgccgtcgccggccccgagcatgtcgacgagcgacggaatcagctccgcgacagcgatttcggcgggcagggacacgtcgacggcctgggtttcccagtgcacactgacccggcacagcccggtagtcgatacggccaacgccattctccttcgctcggattgcgcagaacatagccgggtatcggcgccccggtattcggctgtgcacaggtgagttgccgccgattccggtgctccctaccgtcgtcggccgggaggggatgcgcgatgacccaggccgacatcgttgtcgaggctccgccggaactgccgggccggagtcggcgggcctgccggcccggctgctgccggtggcgctgtcggtggccggcatgggcgtcatgacggtcgtgttcgcctcgggtggcgcggcggcccgccagcccgcgttcctggcgttcccggcgacgatgctggtttcgacggtggcggcggcgctgatcggtcggagccgccgcgggggcggcggactcgacgccgatcgcggccggtatctggaatacctgaatcagctcgcgcggtccgtctccgagatcgccgcggcgcagtgcgcgtccgcactgcgcgaccatcccgatcccgacacgctgtggacgctgatcggcggcccccgaatgtggcggcgccgaccaaccgaccccgacttctgcgtcgtgcgggtcgggatgggtgtcctgccgctggcccgtcgcgtggtggccccgcccgtgcccgccgaggaggttcgcgatccggttaccgcgacggcgttgcgccgtttcctgcatacccatgcgacggtgccgggcccggtcaccgtcgacctgggtgcgggttcgccggtgacgatcgacggcgatggcggtgccgcgcgtgccgtgctgcgcgccgtggtctgccagctcgccgtgctgcatgcgcccgaccggttgggcatcgcggccgtggtcggcgacggcgatcgcgcgcactgggattggctgaaatggctgccgcacaaccggcatcccacgcactacgatgcgctgggcccgatgcggatggtgtattcgactgcggcgcaagcacaacaggcacttgccggcctgccggtggcgcggctggtgctggtcgccgagcgggccgtcgcaccgatcgccggtgccaccgtgatcgcgatcggcgcgggtgacgacggcgcgccggtgacgatccgcaccgccgccggcacggtgtcgccgtcgcgcccggaccggatgaccgccgccgacgccctgacgtgtgcgcgccggctggccgggcagcgggtgaccgccggtgatgacgacggcggctggccgggactggtcgggctggccgatgtgagtggtttcgacccggcgacgctgtggggccggcaaaccgggcgcgaccggctccgagctccgctcggcgtcgccgccgacggcacgccggtcgagctcgacatcaaagagcccgccgaacacgggatgggcccgcacgggctgtgcgtcggcgccaccggttcgggcaagtcggagctcctgcgcacgatcgcgctgggcatgatggcccgaaactcgccggatgtgctcaacctgctgctcgtcgacttcaagggcggcgcaacgtttctcgactacgcgaacgcccggcacgtcgccgcggtgatcaccaacctcgccgacgacgctccgctggtggaccggatgcgcgccgcgctggccggggagatgaaccgccgccaggaggcgctgcgaacggcgggctgcgacagcgtcgccgcctaccaacacgcgcgccggagcgccgccgcgctgccggcgctgcccgccctgttcgtgatcgtcgacgagttctccgaattgctcagccagcaaccggatttcgccgacaccttcgtggcgatcggccggctcggccggtcgctgggcatccacctgctgctggccagccaacgcctggacgagggccggctgcgcggactggacgcccacctgtcctaccggctgtgcctgaaaaccctgtccgaagccgaatcccgcgccgtgctgggcgatctcgacgcctaccacctgcccgccgatcccggcgccggctacctgcgggtcggcgccggcgaaccgatccgcttccaggccgctctggtgtccgggccgctgcgcccggacaccgccccgcgcccgccggcaatggtgcgggtgttcggcacccgggtggtcggcccggtcagccgcccggtcgaggcggcccacccgtccgggcggagcatctccgctgcggtgctggaccggctggccggccacgggccggccgcgcaccgggtgtggctgcccccgctgggccggccgccggaactgtgcaccctgctgggcggcgccgcggacctgaccgtgcccgtcggccttgtcgaccgccccttcgagcaatgccggaccccgctgatcgtcgacctatccggtgccgcaggcaatgtcgcggtcgtcggcgcaccgcgatcgggcaagtcgacggcgctgcgcacttcgatcaccgccctggcggcgacgcacgatccggcccgcgtgcagttctactgcctggacttcggcggcggtgccctgtcgtcgctgcacacgctgccacacgtcggtgcggtcgccggccgggccgaaccgcgccgcgtcgggcggatcgtcgccgaatgcgaggcggtggtgcgccggcgcgaagcgttcttcggcgagcacgccatcgcctcgatcgccgactaccggcagcggcgccccggcagcgatccgttcggcgacgtctttctggtgatcgacggctgggccgtactgcgccgcgacttcgagacgctggaggcatcgatcatcgcccttgccggacaaggtctttcgttcggtgtgcacctggtgttgtcggcgtcgcgctgggccgacatcagacccgcgctgcgcgatcagatcggcacccgcatcgagctgcggctcggcgacccggccgactccgagatcgaccgcagggccgccgcgcacgtgccgcgcgacagcccgggccgcggcctgtcccacgacgggctgcacatggtgatcgcctcacccgtcgccgacgtcgccgcaggcgaatcggtggcgccgccgataccgctgctgccggcgcgggtggacctcgacgccgtgcggcgcggatccggcgacgaattcgccggccgcccgctgctcggcctgcaggaacgccaactgcagcctgtggcaatcgatttcgcgcgggaatcgcacctgctgatcctcggcgccaacggctgcggcaagaccgccgcgctgcgcaccctgtgccgcgaactcgtccggaccaacaccgccgcgcaagcccagctggtgatcgtcgacttccggcgggcgctgctcggcatcgtcgagtccgaacagctgcacggatacgccatgtcgccggccgcgctgaccgcgctgttgcccgggctgctcgacctgctgagcggccggatgccgcctcccgacgccagccaggcccagctgcgggcagggtcgtggtggagcggaccggacgtctacgtcgtggtcgacgactacgacctggtggcctcgccgtccggcaacctgctggcgccgctcgtcggattcctgccgtacgcaagcgaattgggtttgcacctgattatcgcgcggcgcagcggcggcgccgagcgggcgatgttcgagccgctgctggcgggcctgcgtgacctcggctgcatgtcactgacgatgagcgaggcggctccgttcgctgccgccccgccgctgcccccgggccgcggcgtgctgaccacccgggccggcgccgacgaactcgtccaggtggcctggagcccaccgtgagtccacaccgggccgtggtcgagaccggacccgccacgatccgccgattgtgttgcggcacaagaatgccggcggaccgggaggtgatcgaggcggcgctggacgcgatcgacgaccccgtcgcgctggtgggggagcggccggtggccgtcgaggcgttgtggaaaaccgcgctgcggtccgcgtgctgtgcttgcgacggcgcggtcgtcgtgtatccgtcctggtggccgccggcgcgggtgcggacggtgagcgcggccgccgcgaccctggccggcgaggcgcgcgcccggccccggtcatggctgctggcccgcgcgtcccgcgccgcgccggagggcaccgtcgtggtcgaggtcgccgagcgggtggtggccatctgcgggcctgcacccgcgagcgtcacggccgtcccgcgcaccgccccgccgcgatcggtggccgacggcgtcgcccgtgccgtcgcgagcctggcgccggcggtcgtgctgatcgacctcccggacccgatcgccggggcggccgagctgggcccgctcatcgccgacgcgctgcgcgggcggatccgcgcagagatggtgcacatcaacgacattcggctggcccggctggcgtgctcggcgtcggacggtgacgacgcccccgcgggccccgaccgcagcgcggcggcgcccgcccgatcgcggccgcgcatactgagcgggctcggcgcggccgccgtcatcgccgccgcggcggccccgctcgccatcacggccgcgccggatcgggcccggcccatgcccggcacgtccctggtcgaagggcgggtggcgctgtcggtgcccaacgattggccgacgcaacggctggtcggcggaccgggttcggcgcgggtgcaggtcacctcgccgacggatcccgaagtggccctgcacatcacccagtcgccggtcgtcggtgagacgctcggcgacaccgcgcggcggttgaaacaggcgatcgacgccgcacccgccggggtgttcgtcgacttcgacccgaccgcaaccagcgtcggccgccccgcggtgacctaccgcgagatccgccccgcccaccaggtgcgctggacggtgctgctggacggcccggtgcggatcagcatcggatgccagagccggcccggcgccgagcaagccgtccgggaggcctgcgagctggcggtgggatccgcccacgcgatcggatgacgaaaattccgcggaaccgatcgagcgccctggggggtcgaatcaggtatggccacatccaacacagtgagcaccgacttcgacctgatgcgctcggtggcgggcaccaccgacgcccgcaacgaggagatcagggcgatgctgcaggccttcatcggacggatgagcggcgtgccgcccgcggcatggggtgggctcgcggccgcccgcttcaaagaaatgatcgaccgctggaacgccgagtcggtgcggctctaccacgcgctgcacgccatcgccgacaccatccggcacaacgcggccaccctgcaggacgccgggcaaaaccatgcagaccacatcgccgccgccggcggcagcctgtaagggggcgattccgtggacccgacgctgtcctacaacttcggcgaaatcgaacactcggtgcgccaggagatccacaccacctcggcccgcttcaacgccgcgctggacgagctgagagcgcgaatcgccccgctgcagcagctgtggaccagcgaggccgccaccgcctaccaggccgagcagctgaaatggcaccggtcggcgacggcgctcaacgagatcttggtccagctcggcgacgcggtccgcgacggggcggaggaggtggccgacgccgaccgtcgggcggccggggtctgggcacgctagcggcgcgcccgtcaacgtctgtgtggtcccggcggaggagagccgtcgggaccacacagccgttttgacctgcggggacacccgtcggtaagctgctcggttggcgtgcggtacgccggggcctcgggtcaatgtcggtcgccgagatctcaccccaccgcaaaacgcctgatcggcacccggctcgacccgggatccacctcgagaagagaaggtaagcgctgtgcccacttacgcgccaaaggcgggtgataccaccaggtcgtggtacgtcatcgacgccacggacgtggtgcttggccgtcttgccgtcgcggcagccaacctgctgcgcggcaagcacaagccgacgttcgcccccaacgtcgacggcggtgacttcgtcatcgtcgtcaacgccgacaaggtcgccttcagcggccagaagctggacaagaagctggcttaccgccactcggggtaccccggcggtctgcgcagccgcaccatcggcgagctgatgcaaaagcacccggaccgggtcgtggcggacgcgatcgtcggcatgctgcccaagaacaagctcagccgccagatccagcgcaagctccgcgtctacgccggaccggagcacccgcacaccgcccagcagcccattccgtacgagatcaagcaggtggcccagtgaccgaaacgaccgaggccctggagaacccggacaacccggaagccgagaccgcagccgccgaggtgaccgaggccccggtcgaggccgtcccggcggagtcctacgtgttcgagcggcccatccagaccgtcggccgccgcaaggaggccgtggtgcgggtgcggctggtgccgggcaccggcaagttcaacctcaacggccgcaccctggagggctacttccccaacaaggtgcaccagcagctggtcaaggccccgctggtcaccgtggaccgggtggacggcttcgacatctacgcccacctgcacggtggcggcccctcggggcaggccggtgcgctgcggctgggcatcgcccgggccctgatcctggcctcgccggacgaccggcccgcgctgaagaaggccggcttcctgacccgggacccgcgcgccaccgagcgcaagaagtacgggctgaagaaggcccgcaaggcgcctcagtacagcaagcgctgatcagcggtcgctttccggccacaacttggcatcgtggatggacaagttgtggccggttgcggcgtgtctgcgcccggacgcaccccgtttcggccacagtttcggccacaaggaaacgggcacgttaggtgctagcccgtcaactgtgagaggtttgtccgcatgggtcgactattcggcaccgacggcgtgcgcggggtcgccaatcgcgagttgaccgctgagctggcgctggcgctgggcgccgcggcggcgcggcagctggccagcgggtccgcgccgggccggcgggtcgcggtgatcggccgcgatccgcgcgccagcggcgagatgctggaggccgcggtgatcgccgggctgaccagtcaaggcgtcgacgcgctgcgggtgggggtgctgcccacccccgcggtcgcctacctgaccggcgcctacgacgccgacttcggggtgatgatctcggcgtcgcacaacccgatgcccgacaacggcatcaagatcttcggccctggcggccacaagctcgacgacggcaccgaggaccggatcgaagccctggtcggggacgccgggccgcggccggtcggcgcgggcatcggccgggtgatcgacgccgaggatgccgccgaccgctacctgcgccacctgagcaaggccagcacgctgcgcctggacgggctgaccgtggtggtcgactgcgcgcacggcgcggcctccgccgtggccccgcgcgcctaccgcgcggccggcgcgcgggtgatcgcgatcaacgccgaccccaacgggctcaacatcaacgacaactgcgggtcgacgcatctggattcgctgcgcgccgccgtcgtcgcccaccgcgccgacctgggcctggcgcacgacggggacgccgaccgctgccttgccgtcgacgccgacggcaacttggtcgacggcgaccacatcatggtggtgctcgcgctggcgatgcgtgaggccggcgagctggcgtccgacacgttggtgaccaccgtgatgagcaacctgggactgcacctggcgatgaggtcggccggaatcacggtgcgcaccaccggtgtcggcgaccgctacgtggtcgaggagctgcgcgccggtgacttcagcctgggcggtgagcagtccgggcacatcgtgatgcccgcgctgggctcgaccggcgacggcatcgtcaccgggctgcggttgatgacgcgcatggcgcagaccggctcgccgctgtccgatctggcgtcggcgatgcagacgctgccccaggtgctgatcaacgtgacggtcgccgacaaggccaccgccgccaccgcaccgtcggtgcagaccgccgtcggccaggccgcggccgaactgggcgacaccggccggatcctgttgcgcccgagcggaaccgagccgatgatccgcgtcatggtggaagcgcccgagaaagacatcgcgcagcgactcgccacccgggtcgccgaggcggtcagcgccgcgcgctgaggcgcacccgaacggaaccccgacgcgcccgcgggcgtcggattaggcatgaaatcccttggggcaacacggcccggcgccgttgcgcgtacccagatcgacgtggccgccgcgcagcgggtggccaaccaattcgcggtggcggccgaattcctcgaccgcgcggtgaccgatcacctggcccggctggcgttcggcggcgcggtcgccgggcgggcgcacaccgagcgcggcgacgctctgcacgtcgagttgcagcggctggccgggcaggtgtcgcaatggtcgcgggcgtccggtgagatcgccgccgcgctgcggtccagcgccgagcgctacgccgacgccgagctgtacgccgcggcgcggatcgcgtagcgcatggccgaccggttggacgtcgccgggcgcctcgccgagggccgggccggcgtcgagcacacccagacctacgtgcaggcctgccatgcgctgggctaccaacatcccgacctgacggcgcatcccgcgcaggtccgcgaatggtatgcgggcgaggacggtctcgacctgcgcgcgcgctcgaccgcgactgcgccgagctgcgggcggcgggcgtggtggcagccgaggcgctgcggctgcagcgcgcccaggtggccgagctggccgtggcgtggacgggtgcgggcggcgaggcggcggtgcagctgctgcagcggcactgcgacaccgcggaggcgctcgccaccgagctgcgcgccgccgcgcagcggtgtgagtcgctgcgcgacaacctgtggtatctcatcgacgccaaggcggcgacggccatcgccgtggatgaccgcacccgcgcgcagcggccggaatggctggccgccgccgccgcggtgacggcgggacagccggaccgcgatgacgcccacaatctcatccgtcagcaggttatcccctacgtggacaacgatattcgcaacgagtggctgccggcgatgcgctcggccaccgacggggtgcagacgtcctacgccatggtggtcgacaggatggccgccgcgcccgcggcgcggttcgagttccccggtgatctcgggtcgggattggtcccggtgccggccacccggccgctggttgccgcgcccatgccgccgttggatgccgcgcccacgctgccggatgccgcgccgacgctgccggccgccgtgtccgaacccgctgctgccgcaacgcttcccgcggccgtcccatcccccgcggccgccccagccgcggactggggcgccgcgctcggcgacgccgccgggatgcccgcgggtgacctcggtgggctcgccgggagtgggatgggcagcggactcggaagtgggctcggcgggggtgggggtctgctcgggctggccggaaagatcgtcgacgcgatgggtggtctgctcgggtcggtgggcgacggcctggacggagcggacccgttcggcgaccaggatcccttggacgacaacgcttttcacggcgatccttttcacgccgatgaccccgccgacgccaaggacgccggggatgacgctgacgagacggccgccgacgaacccgccgcgccggatcgccccgcgcccgccggcgaggccgaaccgaacggcgagcccgctccgagcggcgaggccccgcccaccggtgagccggcccaacccgtcgcggccacaccgccggccgcgccgccaccgggcgcgccgccaccgggcgcgccgccgccggccgagccgccggccgacccgggcccggcccctggcgcggcccagcccgcgccggagccgggatcgacgccgtgtcagattgccgcagaccagcttccgcaggccggacagtgaccggtcacggccgcaactgcagcgcatgctcgacgaagcccagggcctcgtcccggtcggcggccagcgggctcaacaacagcgtcgtcaccccggactcggcgaacgcggccatccgttcggcgacgtatccgcgcgggcccaccagcgacatgcgccgcaccagctcgtcgggcaccaggtcgatggcctgctgtttgcggccggacaggtacagctcctggatccggtccgcgacctcgccgaacccgtaccgggtggccagattgtggtagaaattgcggcctttggcgcccatcccgccgatgtagagagccagctgcggcttgacccaggccagccgctggtcgacgtcgtcgccgatcgccagcgacgcgtgcaccatcacatcgagtgggcccagcgccggatcacgcttggcggcaccggccgccaacgcctcaccccagatggacccggccttgtccggaagatagaaaaccggctgccaaccctcggcgatctcggcggtgagctccacattcttgggccccagcgcggcaatgctgatcggaatccgttcgcgcaccgggtgattgatcagatgcagcggcttgcccaggcccgtgccgcggtccgggggcagcggcagctggtagtgcctgccggcgtattgcacgcgttcgcgccgccacaccatgcggcagatctccacgatctcgcgggtgcggccgatcggcgcgtcgaacgggacgccgtggaacccctcgatcacctgcgggcccgacgtgccgatgcccaggcggaatcgcccgtcggacacgtaatccagccccgcagccgtcatcgccaacagcgacggcgtgcggatgtagagcggcagcaccccggacgccagctcgacggtgcgggtcttggcggccagatagcccagctggctgatggcgtcgaaggaatacgcctcggccaccaccgcgacctcgatgccggccttctcgagttcgaccacgcggtccacggcctcgtgaaagccacccgaatagttaagagcgatgccgattcgcatcaaacacacttaccacgccgccacctcacttcagcagggcgacgatcttctcttccagcggcacggcgccggcctcgggatcgggggccgccgtcccgggcagctgcacgtgcggatcggcgaagtcgcggtacttcttgtcgccgcccaacgtgtagagcaggtatccggtcagcagcgcccggaccgatcgctgggtgcgccggtgcgcgccggcgaggcccaccaccttggtcagccgccggccctcgaccagcccgcccggttcggccttgctgatgacacgcaccgtggcggcgtcccacacctcggcgagcgccagcgcgttggagttcagcgtcttcgcgtcacccggcgcggtgaggatcacgcccggcacccgcagcgtcgccgccggctgctcggccggcgggctggtcacgctgggaaagaccgccgccaccgccgcgggcttggccggcatgcccgccgcggcgaacaccgccgccgaggcgccgaaaccgtgcccggccacccccagcttggccggatgcacgctgatcttgcccggccccaaccgcacccccgacacgatttccagggcggtccccaggtcgaaggcaaagttcagcaccgacggcgccaacccccgctgggtgtcgggggcggcggccacgatgccccacgacgccagatgctccagcaggttcgcatagcgggcggcgccggtgagccagtcgtggccgaacgccaccccgggcagattcagcccctcctcgggcgtgtacaccaccccgggcagtccggcaaaggccaggtcaccccgcaaaacccggtgcggaccacggcggtgaagcgctgcgacgagcttgcggatgcgggccacgcgtcgacgttagcgcatcgcatcccggcgccggggaaacgcggcccggcccccgctcaggccctgacctcgatgatccccacccgccacagcaacgcgtacaactggtgcagcgggatggccagcaggcgggtggtcatgtccatcaacgggctgcccgagtccgccggcgcgggccgcggcgggcgggcctgccgggccgccggcacccgggtggcggtcaccacatcgtcgcaccgaattgcggtcatgattgcctcctcgtggcgcccggcggccggtcggagaaagtcaattcttctccggctgaattggtggctcggcaaaagacatggcttcggtagccggaattatcctgtccatttccggtaaagccctgaatccgaatggttggccacggtttcgtggccggcacgctgcggaatcgcgatcgggcgggcttcaagcagctcgtcctttccggttgcctcggtactcgccgacggtgctttcccctcgaatgttagaaacacgcaccgcgaacccgatgaagcgaacgaaaacgtcacaaagacatcaggtgaaaacattttcccgggggcagcgacggtcatgacggccgcggcggcgccggcgggcacccgcggactggcggctcggccctgcgcctgcactaccctgagcagaatgtgcggaatcgtcggctacgtcgggcagcagcccgcctgcgcggtcgtcatggccgcgctgcgccgcatggagtaccgcggttacgactcctcgggagtcgcgttggtcaacggcgacggcaccctgacggtgagccgccgcgccggccggctggccaacctcgaggaggcggtggcgcagctgccgccgtcggcgctgaccggcaccaccggcctgggccacacccggtgggccacccacggccggcccaccgaccgcaacgcgcacccgcaccgcgacgccgccggcaagatcgccgtggtgcacaacggcatcatcgagaactacgccggcctgcgccacgagctggaggccgacggcgtggagttcgccagcgacaccgacaccgaggtcgccgtgcacctggtggcgcaggcctaccggcacggcccgacggccggcgacttcgccgcctcggtgctcgccgtgctgcgccgcctcgacggccacttcaccctggtgttcgccaacgccgacgaacccggcaccatcgtcgccgcccgccgctccaccccgctggtgatcggcatcggcgacggcgagatgttcgtcggctccgacgtggcggcgttcatcccgcacacccgcaacgccatcgagctcggccaggaccaggccgtggtgctcaccgcggacggctaccgcatcaccgacttcgacggcaacgacgacctggggcccggggcgtaccgcgaattccacatcgactgggatctggccgccgccgagaagggcggctacgagtacttcatgctcaaggagatcgccgagcagcccgccgcggtggccgacacgctgctcggccatttcgtcgacggccgcatcgtgctcgacgagcaacggctgtccgatcaggaactgcgcgaggtcgacaaggtgttcgtggtggcctgcggcaccgcctaccactccgggctgctggccaaatacgcgatcgagcactggacgcggctgccggtggaagtggagctggccagcgaattccgttaccgcgacccggttttggaccgcagcaccctggtggtcgccatctcgcagtccggcgagaccgccgacaccctggaggcggtgcggcacgccaaggagcagaaggccaaggtgctggcgatctgcaacaccaacggcagccagatcccgcgcgaatgcgacgccgtgctctacacccgcgccggcccggagatcggcgtcgcctccacgaagacgttcctggcccagatcaccgccaactacctggtcggcctggcgctggcgcaggcccgcggcaccaaataccccgacgaggtcgagcgggaataccacgagctagaagccatgccggacctggtggcgcgggtgctggcgacgatcaagccggtggccgcgctggctcagcggttcgcccagtcgccgaccgtgctgttcctgggccgccacgtcggctacccggtggcgctggaaggcgcgcttaaactcaaggaactggcctacatgcacgccgagggattcgccgccggcgagctcaagcacgggcccatcgcgctgatcgaggacgacctgccggtcatcgtcatcatgccgtcgcccaaagggtcggccgtgctgcacgccaagctgctgtccaacatccgcgaaatccaggcccgcggcgcgatcaccatcgtcatcgccgaggagggcgacgacacggtgcggccgtacgccgatcacctgatcgaaatcccctcggtatcaacgcttctgcagccgctgctgtcgaccatcccgctgcaggtgttcgccgcgtcggtggcccaggcccgcggctacgacgtggacaagccgcgaaacctggccaagtccgtcacggtggaatagccgggcaacggcttcacccggataagccgcgcatccgcggtcgatcgattacattgccctgggacagcatttcggcgccagtgagcaaggcgcccatgcccgttcgggaggaagtatgcgatcggccggcatgagatacggcgtcgttggcctggtggtgctcgtcctggccgcatacatcggctcggtcgtgctgtacgcgcaaagcggcaccggccgccggatcgatgaggccaacccgacgatggacggggaccggccgtcggcgacgatcaacgtcgaagacatccagtcgaacaacagcgtgctcgccgtcaacctggccttcaatcccgggtcggcactgctggatccgaagacccaccacctcaaggaggatctgagcctgcgggtccgatcctcggcgatgccgtcccggcacacctggaccaagggcatgctgcccggcctgatggccgtcccgctgaccatcgccggccagatcgagcgctggccgttcgaccaataccactctggcccgctggaagtcgagatcttctacggcccggacaccgaccgggaccccgaccacgtccccgtcaccttcgtcgaccacctgtccggctggcagctcaccgcgacccggccccaggccgacggcccctaccggctgcacgtgcggcgctcgatgagcaccgcggcgttcgccatcgtcatcctcggcgtgctgatcgcgatcgccagcctggccctgttcgtggcgatccagaccacccgggaccggcggccgttccagccgccgatgacgacgtggtacgcggcgatgctgttcgcggtggtgccgctgcgcaacgcgctgcccggttcgccgccgttcggcagctgggtcgacatcaccgtggtgatctgggtgctggtcgcgttggcgatctcgatggtgctctacatcggctgctggtggcggcatttgaacccgccgccggccgccgcgccggcccagccggcccagccggcccccgcgacgacaggcggctgacgagcggcggcgtgttcgcccccgaagtcgtacgcatgacatgccacgcatgccaaggttgatgtcgtggggcaggcatcggttcgggggcgagtgcgcggcatgacgcgggcggtgtggcacttcgtcatcagtgccccgctgacctacggctggctgttggtgctgatgatcaccaccatcatccagaaccagctcaccggccggcagctgcattcggtactgctgcaccgctccaccaacattcacgagctgggccgggacccgctggacgtcctgttttccagcttgctgtggatcgacggcaagaacttcgagccctacctgctgctgttcaccctgttcctggcgccggccgaacactggctcggtcagctgcgctggctcaccgtgggattgagctcgcacatcctggccacctacatcagcgagggcattctctacttcgccatcgagaaacacgacgcgtcggagcggctggtgcacgcccgcgacatcggggtgagctacttcctggtcggggtgatggcggtgctgaccttccacatcgcccggccgtggcggtggggctatctcggggtgctgttcctcatcttcggtttcccgctgctcaccatggaccgcgtcgagctgaacttcaccgcgatcgggcatttcacctcgatcctgatcggcctgtgcttctacccgatgacccgcgccaagggcgggcggcagctcagcccggcgcggctgcgcgccatgctgcgccggcgcgtggcgccgccggcccggcccgacgtcgactccggccggtaacgacgactccggccggtaaccaaaggtgccgcgcgccaagcacgtgcacgtaatctggctctgatgcggcattactacagcgtggacgcgatccgtgcggccgaggcgccgctgctggccagcctgcccgacggcgccctgatgcgccgggcggccttcggattggccaccgagatcgccgccgagttgaccgcccgcaccggaggggtggccgggcggcgggtgtgcgcggtcgtcggctccggcgacaacggcggtgacgcgctgtgggcggccaccttcctgcgccggcgcggcgccgccgcggacgccatcctgctcaaccccgagcgcgcccaccgcaagggcctggccgcgttcggaaaggccggtggtcgcatcgtcgaaagcgtttcgccgacaacggatctcgtcatcgacggggtggtgggcatctccggctcgggggcgctgcggcccgccgcggccgaggtgttcgccgccgtcgacgacgcgggaattccggtggtggccgtcgacatccccagcggcatcgacgcggcgaccggggcgacaagcggccccgccgtgcacgcggtgctgaccgtcaccttcggcgggctcaaacccgtgcacgcgctcggcgactgcggacgggtaaagctgatcgacatcgggctcgacctgccgcagaccgacgtgctggggttcgaggccgccgacgtggccgcccgctggccggtgcccgggccgcacgacgacaagtacacccagggcgtcaccggcgtgatggccggctcggccacctatcccggcgcggccgtgctgtgcaccggcgcggccgtcgcggccacctccgggatggtccgctacgccggcagcgcgcaccgggaggtgctcgcgcactggcccgaggtgatcgcgtcgcccaccccggcgtcggccgggcgggtgcagtcctgggtggtcggcccggggctgggcaccgacgacgccggggccgccgcgctgtggttcgccctggaaaccgacctgccggtgatcgtcgacgccgacgggctgaccatgctggcggcccaccccgagctggtggccaaccgggcggcgccgacggtgctgaccccgcacgccggggaattcgcccgcctggcaggcagcccgcccggcgacgaccgcgtcggcgccacccgcaaactggccgacaccctgggtgtcaccgtgctgctgaagggcaatgtcaccgtcatcgccgaccccggcggccccgtctacctcaacccggccggccaatcctgggcggccaccgccggctccggcgacgtgctgtccgggatgatcggcgcgctgctcgcctccggattaccggccggcgaggccgccgcggccgcggccttcgtgcacgcccgcgccgcggcgctttcggccgccgaccccggccccggcgaggcgcccacctcctcgtcgcgcatggttccgcacatccgggccgccctggccgccctgtagacctatagagaggaattccccagtgccccaacatccttcgctgcccgcgcatgccatcgccccggcctacaccggccggctgttcaccgcgccggtgcccgctctgcggatgcccgacgaatcgatggatcccgacgccgcctaccggttcatccacgacgagctgatgctcgacggcagctcccggctgaacctggccaccttcgtcaccacctggatggaccccgaggccgggcggttgatggccgagacattcgacaagaacatgatcgacaaggacgaatacccggccaccgcggccatcgagcagcgctgcgtgtgcatggtcgccgacctgttccacgccgaaggtctgaacgacgccgacccgtacagcgcctgcggggtgtccaccatcgggtccagcgaggcggtgatgttgggcgggctggcgatgaagtggcggtggcgcgccaagaccaaggactggaagaagcgcaccccgaacctggtgatgggctccaacgtccaggtggtctgggagaagttctgccgctacttcgacgtcgagccccgctacctgccgatggaggagggccgctacgtcatcacccccgaacaggtcgtcgacgccgtcgacgaggacaccatcggcgtggtggccatcctgggcaccacctacaccggcgagctggaaccggtcgccgacatctgcggcgcgctggacaagctggccctcaaaccagcatcagccggcggcgtggacgtcccggtgcacgtcgacgccgccagcggcgggttcgtggtgccgttcctgcaccccgagctcaagtgggacttccggctgccccgggtggtgtcgatcaacgtcagcgggcacaagtacgggctgacctatcccggcgtcggcttcgtggtgtggcgcagcaaggaatacctgcccgacgagctggtgttccgggtcaactacctgggcggcgacatgccgaccttcacgctgaacttctcccgccccggcaaccaggtggtcggccagtactacaacttcctgcggctgggccgcgagggctacaccaaggtgatgcagacgctgtccggcacggcgcgctggctgggcgagcagctgcgggtcagcgagcactgcgagctgatctcggacggctcggcgatcccggtggtcgccttccggctggccaagaaccgcggctacaccgagttcgacgtctcccacgagctgcgcacctacggctggcaggtgcccgcctacaccatgcccgacaacgccaccgacgtctcggtgctgcgcatcgtggtgcgtgaggggctgtcggccgacctggcccgggcgctgcacgacgacgccgtctcggcgctgacctcgctggacaaggtcaagccgggcggccactacgacgcccagcacttcgcgcactgagactttgcgccgagcgtgcagccacggcgattttttcgcgattttttcgccatgagtgcacgttgggcactgggagagagcacgcgcgcgtttctgggacaatggccgccgtggccgttacgccgatatccctgaccccgggcgtcctcgccgaggcgctggtcgacctgggcgccatcgagcacaacgtgcggctgctgtgcgagcaggcccgcggcgcgcaggtgatggccgtggtcaaggccgacggctacggccacggggccgtgcagacggcgcgtgccgcgctggccgccggggccgccgagctgggcgtggccaccgtcgacgaggcgctggcgctgcgcgccgcggggatcagcgcgccggtgctggcctggctgcatccgcccggcatcgacttccggcccgcgctgctggccggcgtgcagatcggcctctcctcgcagcgccagctcgacgagctgctgaccgcggtgcgcgacaccggccggaccgccacggtcaccgtcaaggtcgacaccaggctgaaccgcaacggcgtgccgccggcgcagtacccgtcgatgctgaccgcgctgcgccgcgccgtcgccgaggaggccatcgtgccgcgcggcctgatgtctcacatggtgtacgccgaccaacccgccaacccggtgaatgacgttcaggcgcaacggttcaccgacatgctggcccaggcgcgcgagcagggggtgcgcttcgaggtggcccacctgtcgaattcgtcggccaccatgtcgcgtcccgacctggccttcgacatggtgcgcccgggtatcgcggtgtacggcctcagccctgtccccgagctgggcgacatgggcctggtgcccgcgatgacggtgaaatgtactgtggcactggtgaagtcgatacgtgcgggggaaagcgtgtcatacggacacacctggacggcgcagcgcgacaccaacctggcgctgctgccggtgggctacgccgacggcatcttccggtcgctgggcgggcggctgcaggtgtcgatcaacggccggcggcggccgggcgtcggccggatctgcatggaccagttcgtcgtcgacctgggcccgggccgccccgacgtggccgagggcgacgaggcgatcctgttcgggccgggcagcaacggtgaacccaccgcccaggattgggccgatctgctcggcaccatccactacgaagtggtgaccagcccccgcgggcggatcaccaggacctaccgcgaggcgcacaccgttgagtcctgaccgaacccgcaagcgccacaagggcaggacctggcttgcggggggcgcgggggtgaccgcggtcgccaccatcgtcggggcctcggcccgccggtccatgacccagcgggccaccatcgaagacccttacgccgacgaggatttcaacaccttcgacggtgaccgcgccctggtggtgaccacacccgacggggtgccgctggcggtgcgcgaagccggcccgcccgacgcgccgctgaccatggtgttcgtccacgggttctgtctgcagatgggcgccttccattttcagcggacccggctgcccgaacagctgggacccgacgtgcggatggtcttctacgaccagcgcgggcacggcagatccggggaggccgcacccgagagctacacgctgacccagctcggccgggacctgcaaaccgtgctgcaggtggtggcgccgcgcgggctggtggtgctggtgggccactcgatgggcggcatgaccgtgctctcgcacgcgcgccagttccccgagcagtacggccgccggatcgtcggtgccgcgcttatttcgtctgcggccgaaggggtttcgcggtcgccgctgggtgagatcttgaaaaaccctgcgctggaggcggttcgggttgccgcccggtcggcgccgaagctaatgcaccggggccgcaacgtgtcccgctcgctgatcggcccggtgttgcgggccgcctccttcagcgacctgcaggtcagccggagcctggacgcgttctcccagcggatgatgaacagcacacccatcccgaccatggtgggctttctggacgcattggaacaccacgacgagaccgccgggctgtggacgctgctgcgggtccccaccctgatcgcctgcggcgaccacgacctgctcacctcggacgagtattcccgcaagatggcggccagcctgccgcagtccgagctcgtcatcgtcgccggggccagtcacctggcgctgctggacaagccggaggccatcaacggcgggctggtgcggctggtccgccgcgccaccccgagccgggccgcactggcgctgcggcgaatcggggaaaggttgtggcgccgtggctgaatccggcaccgcgacgctgcccaccgcgcaggacaccgccgcgctcggcgcgcggctggccgagcagctgcgcgccggcgacgtggtggtgctctccggcccgcttggcgccggaaagacggtgctggccaagggaattgccgcggcaatggatgtcgacggcccggtcacctcgccgtcctatgtgctggcccgggtgcacccgccgcggcggcccggcgcgccgacgatgatccacgtcgacctgtaccggttgctcgaccacaccggcaatcagggtgccgacctgctcggtgagctcgactcgctggacctggacagcgatctggacgacgccgtcgtggtggcggagtggggtgagggcctggtcgagcgcctcgcgccgcggcacctggacatccggctggagcgggtcagcggatccgacgtgcggatcgcgacctggcgctgggccggcggggagccgtcatgagcccgctggtgctggccctggacacctccacgccggcggtgaccgccggcatcgtgcgccgcgacgatctgtccgtgctggcccagcggatcaccgtggacgcccgggcgcacgccgaacggctgaccccgaatgtgcttgccgccctgcacgattccgggctgaatatgacggacctggtggccgtcgtggtgggctgcggcccgggcccgttcaccggcctgcgggccgggatggccaccgccgccgcctacggccacgcgctgggcatcccggtgcacggcgtgtgcagcctggacgccatcggcgggcagaccaccggcgacacgctggtggtcaccgacgcgcggcgccgcgaggtgtactgggcccgctaccgcgacggggtgcgcaccgatggtccggccgtcgccgcccccgccgacgtcgacccgggtggggccgaggcggtggccggctccccggagcacgcgcgcctgttcggcctgccggtcaccggacccgcgcacccgacgccggccggactggttgcggcagtgggcgattggtcggtccggccgcagccgctggtgccgctgtatctgcgccgcccggacgccacaccgcgggcggcccggccatgaccgcgggcggcgaaccggtcaccgtcggcgccttgacgcgggccgacgcgcggcgctgcgccgaactggaggcgcagctcttcgacggcgacgacccgtggccggccgcggcgttccaccgcgaattggccagtgcgcacaaccattacgtcggtgcgcgggtcggcgacacactggtcggctacgccggcatctcccggcttggccgggttccgccgtacgagtacgagatccacaccatcggcgtggacccggcataccagggccggggcatcggccgcctgatgctcgaccggctgctcgagttcgccgacggcggtgtggtgtatctggaggtgcgcaccgacaacgagccggccatcgggttgtatcgcagcgtcgggttcgagcagatcggcctgcgccggcgctattaccgcatcagcggcgccgacgcctacaccatgcgcagaaaggcccggcagtgacgaccatcctggcgatcgaaacctcttgcgacgaaacgggagtcggcatcgcgcggctggacgccgacggcgcggtgaccctgctggccgacgaggtcgcctccagcgtcgacgagcacgtgcggttcggcggcgtggtgcccgagatcgcgtcgcgcgcacacctggaggccctggggcccaccatgcgccgcgccctgtccgccgccggcgtgaccaaacccgacgtcgtcgcggccaccatcgggcccgggctggccggtgccctgctggtgggagtcgctgcggccaaagcgtattcggcggcctggggggtgccgttctacgccgtcaaccacctgggcgggcacctggccgccgacgtctaccagcacgggccgctgcccgagtgcgtcgcgctgctggtctccggcggccacacccacctgctgcaggtgcgctcgctcggcgacccgatcgtcgagctgggcagcaccgtcgacgacgccgcgggcgaggcctacgacaaggtggcgcggctgctggggctgggctacccgggcggccgggtgctcgacgagctggcccgcaccggcgaccgggaggcgatcgtgttcccgcgcggcatgaccggcccgcgtgacgccccgtacgcgttcagtttctccgggctcaagacggccgtggcgcggtacctggaaagccacccggacgcggtgaacgccgacgtcgcggccggcttccaggaggccgtcgccgacgtactgacccgcaaggcggtgcgcgcggccaccgacctcggcgtcaccaccctgctgatcgcggggggagtggccgccaactcgcggctgcgcgagctggccgagcagcgctgcgcggcggccgggctgacgctgcgcataccccggccggggctgtgcaccgacaacggggcgatgatcgcgtcgttcgccgcgcatctggtggccgccggggcgccgccgtcgccgttggacgtgcccaccgatccgggcctgccggtggtgaaagcgcaggtcagctgatcgccgacggcgaacacacgagaagcagcggagtgcccttgagtgctagcactcgcatgtatagagtgctaggtggcaatcgaccaagcccggtgtcggcacccgcgacgacggcgctcgggcatggacgaatgccgaacacctgattattcggcatgttcggggcgcgccccggacccgacccaaacactggagggctccaatcgtggcgaaggtgaacatcaagccactcgaggacaagattctcgtgcaggccaacgaggccgagaccacgaccgcatccggtctggtcattcccgacaccgccaaggagaagccgcaggaaggcaccgtcgtcgccgtcggtcccggccggtgggacgacgacggcgcgaagcgcattccgctggacgtctcggaaggcgacaccgtcatctacagcaagtacggcggcaccgagatcaagtacaacggcgaggagtacctgatcctgtcggcgcgcgacgtgctggctgtcgtctccaagtaacaaccgtgtcccgccccggcgatccccgcgtccccacgcgggtgatttccggggcggcatgcgttacagcccggtttgaaggagcctgatgagcaagatcattgagtacgacgagaccgcgcgccgcgccatcgaggccggcgtcaacacgcttgccgatgcggtccgggtgacgctgggtccgcggggccggcatgtggtgctggccaaggcattcggcgggccggccgtcaccaacgacggcgtcaccgtcgcgcgggaaatcgacctggaggacccgttcgagaacctgggcgcccagctggtgaagtcggtggcgaccaagactaacgacgtcgccggcgacggcaccaccaccgcgaccgtgctggcgcaggcgctggtgaagggcggcctgcggctggtggcggccggcgccaaccccatcgagctcggcgccggaatctccaaggccgccgacgcggtgtccgaggcgctgctggcctcggccaccccggtgtccggcaaggacgcgatcgcccaggtggcgaccgtgtcgtcgcgtgaccaggtgctcggcgagctggtcggcgaggcgatgaccaaggtcggggtcgacggcgtggtcagcgtcgaagagtcctcgacgctgaacaccgagctggagttcaccgagggcgtcggcttcgacaagggcttcctgtcggcctacttcgtcaccgacttcgacgcccagcaggccgtgctggatgacccggtgatcctgttgcaccaggagaagatcagctcgctgcccgacctgctgccgatgctggagaaggtcgccgagtcgggcaaaccgctgctgatcatcgccgaggacatcgagggcgaggcgctggccaccctcgtcgtcaactccattcgcaagacgctgaaagccgttgcggtcaaggcgccgttcttcggcgaccggcgcaaggcgttcctggaggacctggccatcgtgaccggcgggcaggtgatcaaccccgacaccggcctgctgctgcgcgaggtcggcaccgaggtgctcggctcggcccggcgggtggtggtcagcaaggacgacaccatcatcgtcgacggcggcggcgccaaagacgccgtggccaaccggatcaagcagctgcgcgccgagatcgagaagaccgactccgactgggaccgcgagaagctgcaggagcggctggccaagctggccggcggcgtggcggtgatcaaggtcggtgcggccaccgagaccgcgctcaaggaacgcaaggaaagcgtcgaggacgcggtggccgccgccaaggccgcggtcgaggagggcatcgtcgccggcggcgggtcggcgctgctgcaggcccgcaaggccctcgacgagctgcgcggatcgctgagcggcgatcaggcgctgggcgtcgacgtcttcgccgaggcgctgggggcgccgctgtactggatcgccagcaacgccgggctggacggcgcggtggccgtgcacaaggtcgccgagctgcccgccggccacgggctcaacgccgagaagctcagctacggcgacctgatcgccgacggcgtcatcgacccggtcaaggtgacccgctcggcggtgctcaactcggcctcggtggcgcggatggtgctcaccaccgagacggcggttgtcgacaagccggccgaggaggccgacgaccacggccacggacatcaccatcactaggtctgccgagcagacgcaaaagcccccgacacgccctgcgtgcgggggcttttgcgtcttctcgttccctacggcggacgtttagtctcgcggcatggatcgcatctggcagtgggtgtgggatcggcacggcgcgaagtatccctgggtcatctgggcattcgggttcacatcgatgttcgtgacctatgccctttggtcgctggtcatcacttgttacgagagatcgagtcactatctcgaagcggtcgtcgtcaccggtgtgggcgttgtattgcagtcattagtggtgctgcctgttcggcgacgatttcgcttgatgcggccggtgtcggccagtgaccaggtcgatcgattccaggcgctcaacgaaacgtacgtgtggagtcggacagcgcgcatcagacagttgtggtttgtacccatttgggctgcaacgtttttcgcgattgtcagtgtgctcgccggagctcatgggatgcgggtcgtcgagtacgtgatcgtgggtggcgctatgggaatcgtcacgacactgatcagtttgcacaccttcatggagggatcattacgcccggtgagagcagcgctggcgggggattcgggcatcggcgacgctttaccgcgctcccgcccgaccttcgcctggtggttggaagtctcgatgctcagcgctctgtgcaacttcacaaccgcgggcatgatggtcggagccctgctcggccgggtcagcgattccccgctgctgcccctcttgatcgcctgcgtggcgacggcggcactcgcggcgccggtcaccgtgggtgccattgtctcaccggcattgcatccgatccgtgacctcgccgagggcactgaacgcgttgcggcaggcgattacacccgtcgcgtgccggtggtccaggacgacgatctcggcgcgctgacggcgtccttcaatcggatgcaggcgggattgactgagcgacaacggctgcaggcggctttcggcacttacgtcgacccggctctggcggcccgactgctcgagcagggcgatgacgtgttcaccggcgagcgccgcgaggtcaccgtgatgttcgtcgacgtccgcgatttcacgccgttcgccgaggccaatagcgccgaggacaccgtcgcgcgtctcaacgctctgtttgagatcgtcgtgcctgcggtcgtcgacggcggcgggcatgtgaacaaattcctgggagacggcgcactggcggtgtttggtgccccgaatgatcttgcggatcatgcggatgcggcggtgagcgcagcgctgctgattcatcgcctcgtcgctaagcgtttcggcggtgtgcttcgaatcggcatcgggatcaacaccggtgtggtgatcgccggaaccatcggcggcggcggcaaacttgagttcaccctcattggtgacgccgtcaacgttgcggcccgcgtcgagcaactcaccaagacgaccggtgacgcgatccttgttactcagcaaaccgtagacgccttggtttctcgaccgcccggactgagcgacaggggtactcacgccctgaagggcaagtcagcccccacagcggttttcggcctcgacccagccgtcacgccttcgcatcgcctcggctgaatgccgaacgctcgccacccagtgggatggcatggtttacattcagcactgtagatccttggatctcgatcgattgcgtatcgcttcccggtccattccacggcgctttgcgcgccgagcagatcgggtatctgacgagccgaaggggtggtacttcgccgtggtgtcctcgtcgtcttcggtggacgacagcggtcgcgcgacagtccgacaggtgactctagccgtgctagacgggtgatcgtgttgcatcggagtcggtcttggcgacgtccgcgaatacggttacctgatctgtgccgcgatcgagttgaggccgatgtgcgacgagatctgttgtactgcttcggttctccgtcgattctgtatcgatggccccgtcattcgactgcttctgagcgccgagggcacccgagaatcacaagccgcagccggtacctggacaccgttctcgaagccttcgccctgggtctcggtcgtcgcgctttacaggctgaggagaacccgtgacccgtccggacgcttgacggacacttccagctcacccccagtcgcttccacgtacttgcggagagtgtcgacccggctcgtgcccagatcgccatgttccatctgcgagacgcggttctgcccgacgccaatagccgcagcgagagtcgtctgcgtgtagccggcagcctcgcgcagttcgcggagacggtactgggcaacctcgcggtccatctccgccttgatcgcgtcgatacgggtccggttgccgggacggcgacggcgcatgtcatcaagattggtcatcgtttctttcccttccttggtttccgattggtggctttggctgctgccttgtgtaaacgcttttggtgagcatcgaagagctcgtcggcaatgggaatgtgcttggcataccacttggaccaattgcccgccttgtctccagcgatcaacatgatcgcccgcgaccgggtatcgaaggcgaatagcacgcgaatgtgggctccagctttcgtggggcgcggacggagctccttcatgttcgggtgccttgacccttcaagggtgtccacaaacggccgccgggtaattggaccgtgttcctccaactgctcgagcgctgctatcaagttgtcgtactcctcgtcatcgagggcatccatccaggcttcgatgagagtcaggtcaacctcccatttccgcactaccgcatgatatcagctaggggtgatgtctcgagtgtccgggtccccaaccgcccatggtcggacgacttgaaccgatcaccatcccggtgcggattgacctgcgtttcacacggcggcgcgacgccggttttgaaggagttgcataagtcgcgacgcgattcctccacgccttgtccgacgctgcggttatgctgacccagcctgtagataggtcagctaagtagcaaggggacttcatgacgcagccaacagcgggttggtatcccgatccatctaatccgagccgccagcggtacttcgacggcacagcgtggaccgaaagttatgcgccatttcccgcgccgccacccggcgttggccagcccgtgaagcccagccgccagaagaagtccgataagaagtggatcctaggcgccggagccgtagtggtggtcctgattgccatcgccagcggcggcaacgacggcgacaagaagaccgtcgcggagtcgaacacggcagcgtcggtcccctcaagggcaagcgcgccgacgaagccaaagcatgtagggcctgccgtcgcccccgctgggtccccggtgcgagacggtaagttcgagtttcaagtgcttggtgtcgatcgctcggccactaaggaaggggtcttcagtttgcagcaagccaagggcgagtttttcgtcgtgaagctccgcgtgacgaacatcggcgacaagtcccaaagcttctctgcttccaaccaaaaactgatcatcgacggcaagaagtttgacgcgacgacctcgctcagcgacaacacctggatggaagacatcaaccctggcctcggtatggatgggagcgtctcgttcgacatcccgccgggcgcggtgccggaagcgatagagttccatgactcgatgttctcgggcggggctcgtgtagctctgtagcggccgtcgaggttggacggcctagtggttggacccgggaggtagcctgcgcaagtgatccggactcaggtgtgcgttgccgggggcggtcccgccgggatggtgcacgcgctgctgctcgcccgggccggaatcccggtcgtcgtcttggaaaagcacaacgacttcctgcgcgacttccgcggcgacaccgtgcatccgaccacgctgcggatcatggacgagctgggcctcatcgacgagttcctgcgcctgccgcacaccaagatcgacaccgtcgccttcgacaccgacggctcgattcgcaccttcggcaacttcaaagtgctcaagcggctcggtttcaaccagccctatatcgccatgatgccgcagtgggactttctcgacttcatcgccgaaaaggcttctgcctacccggaattcacgcttatccgcaacgccgaagtgaccgacctgatcctcgagggcgatcgagtggccggcgtgcgcaccccccacgacgaggtgcgggcggatctggtgatcgccgcggacggacgcaaatccgcggtgcgggccgccgcggggctgcggacggcccaggcgcactcgccgatggacgtgctgtggttccggctgaaatggcgtccgggcgatccccgggagctgttcggcgtgttccgtaagggcctgatgatggccatgatctaccgcggcgactactggcaagtcgcctatctgatgccgaagggcgccagccccaagggcggatcgttggaggagttcaaggaacggatcgtcaccgcgcagccgcggttgcgcgaacacgtgaacgacctgacctcgtgggacgacaccagcgagctcgacgtccgggtggacaggctcgaaacatggtggcgcaccggccttttgtgcatcggcgatgccgcgcacgccatgtcgccggccggcggcgtcgggatcaacctcgccgtcgccgacgcggtggccgccgccaacatcctgtgcgcgccgctgcaacagggcctggtgaccgatcgcgatctggcgaaggtgcagcggcgacgcgaactgcccacccgcatcgtgcaggccgtccaggtcctgatgcaggacaacgcgatcgcgccgaacctgaacggtgacctatccccgatccacgtccccaagatcgtgggattcggtccgctgcaagccattccgccacttgtggtcggccgcggtttccgtcccgagcatgtccgcacgccggacgtgcacgcacggtagcgccgtcagagcccaacgatgatgatgacgatgcccaccacgatgcacaccgagagggacaagggccaccgccgtgacgccccaggcgccgggcaagtggaggtgcggccacagcaggccgagcagcacccggtgagcagcccgtgggcttgagcgtcaccgcccgggcggcaggctgggcggcgtggtcacggtggtggtcggggtggacgtcgcggtcggggtgccggtgaccgtgaccgtgctggtgctcgtgctggtcgacggcggcggcaccgcgacggtggtggtgctcgtcgtgacgctggtcgtcggcgtggtcgtggtggaggtggccgacgacgccgcgatcaccccgcaggccagccgtttaccggaatcggcggcgggcgtgttggccaggttgttcgcgttctggtgcaggatcagcgcgctgcccgagctggtcctcaggtccgcggcggtgaacgcgttgctggtggtgaccagtttcgccgaaccgtcggagcgcacctgcagcgcggtcaaatcgccgctggcgggatagccggtgtggtccggcgcctgatagaccgcgccggcggattcgaagtcaccggtcgaaccgcccgtcggcgcagtcgaattcgcctcgcacttgcccaccgcgtggatctgcaggccgtggaacccggggctcagcacctggttcgggccggcttccacggtcaccgtcgcgtagccgttcgcgaattcgaagctggcgttggcgaccgggatcccctcggcggtcttgagctgggtggtcaaccgctccgatccgggcaccgagctggtcagcggtgcggtgttgggttggctgctctgctggttcgcgcaggcggccagcggtgcgatggccgcggtgaccgccgccaccgcgaaggttgcgcccttgtgcatgggcgctgcctacccggatcggcgcaggccgaaacggcggtctcaggccgagcggcggataccgcgcccgcggccgatctcgcccttgagcaacaggtcacgctcggattccgacaggccgccccaaaccccgtacggctcgccgacttccagcgcgtgcgagcggcactcctggatgaccgggcactgccggcacatttccttggcccgctgctcgcgctgcatgcgggcgcggccgcgctcgccgtcgggatggaagaacatggacgagtcgacaccgcggcacaagccgtgcaattgccaattccagatgtcggcgttgggcccaggtagctgctccggctgtggcattggttcgttccctctctgcaccgcccactcgaggtcaggtcgtgaaagcgatggtgtgcaacttaaattaagtggagcggagtccccgatgactacccgtctcgcctagacggtaggggggacggcgaatttccgtcaatagccacttagcccggcaaagtatgtgtccgtccgcgcaaaattaacgttgcgttcatgtccgctgaaattgccaaagcaatgccgtgctaccaggcacttgatcgaaacgtgatttcccagctcagcgcgcgggcgacggtccggtggaatttatccatgggctatagtcattaacggatcggtaacaagaagatcacaaactgtttactacatcattgtgattgaaactcgtcacacttcggcggtcgggggcgcggtgcaggccgacgttgccggctccgtcgaccggttgttggccgaggccgcattcggcgaccggcccgaccgctggcccctgcccgcggcgggcacgcccgcgcagctgtggttgcgcgccgtcgccgccggggggcagggacgttacggcgccgcgctgcacgatctggcgcggctgcgccgcaccgcgaccgccgggcggctcgcctcgctggcgcacagcacccaggggtcgttcctgcgccaactcgggtggcacgcgctggcgcggggctgggacggacgcgccctggcgctggccggcgacgaccccgaggcgggcgccgacgcgctgatcgggctggccgccgatgccctgggcgtcggccgcttcgcggccgcggcggcgctgctggcccgcgtcgagccgctgctggactcggaaaacattgtgccccagcgtatttcggtgcgccgcggttgggtggccgccgagctcgcgatggcccgcggcgacggcgaactcgccgtccggcgcgccggggaggcggtcgaggcggcggcggccacggccgcgggtgcggccggggcggcggcgcgccaccgggtcaaaagcgaggtggtgctggccgccgcgctgtgcagcgccggggatatcgagcgggcccgcgcggtcgccgacaccgcgctgcacaccaccgcccggctgcggctggtgccgctgcgctgggcgctggcgtgcttgctgatcgatatcggaagtgtggagttttcgtcacggcaactgcacgaaatccgggaagtctgcgcaggccaggtgcggcgcgccggaggaacgtggcgttccgcttgaaacggccgtcggcccgttattgtcatttcgttagttagcccggttggcccgcgatgtgtccgcttcgtaacgttggagatatcaccgtcgatgacaattccagcaggggaacgtctcgatgctgtggtcgccaaggccgtgacgggagaccacaacgcactccgggaggtgctggagaccatccgcccgatcgtcgtgcgatattgccgggcacgcgtcggcacggtcgagcggggtggcctgtcagccgacgacgtggcacaggaggtgtgcttggcgaccatcacggcgctgccgcggtatcgcgaccgcgggcgccccttcctggctttcctgtacggcatcgcggcccacaaggtcgccgacgcgcaccgggccgccggccgcgacctcgcctacccgaccgagtccatccccgatcgctggtccaacgatgcggggcccgaacagcttgccatcgaagcggattcggtgagccggatgagtgaactgctggaaatcctgccggccaagcagcgcgagatcctgatcctgcgcgtcgtggtcggcctgtccgccgaggagaccgcggccgccgtcggcagcaccaccggcgcggtccgcgtcgcccagcaccgcgcactgtcgcggttgaagtccgagatgatcgcggcaggtgactgtgcctgaatccctggatgaattcgcccgcaccgacctgctcctcgatgcgctcgcccagcgccggccggttccccggggacaggtcgaggaccccgacgaccccgacttccagatgttgaccaccctgctggaggactggcgcgacaacctgcggtggccgccggccagcgcgttggtgacgcccgaggaggcggtcaacgcgctgcgcgccggcctggccgaacgccgccgcggccaccgcggcctggccgtggtggggtccgtcgcggccaccctgatgctgctcagcggcttcggcgcgatggtggtcgaggcccgccccggcagcaccctgtacgggctgcacgcgatgttcttcgaccagccgcgggtcaacgaaaaagaccaggtcatgctggcggccaaggccgacctcgccaaggtggccgaatcgatcgacaaggggcagtgggaccaggcccgcacgcagctgaccgaggtgagcagcctggtcgcctcgatcgacgacccggccaccaaacaggacctgatgacgcagctgaacctgctcaacgccaaggtcgattcgcgcaaccccaacgcgacgctgcccgcggcggccccctcgatggccccgtcggtcgccgtgccggccgcgcccccgccggccgcgtcgatcgcgccgaccccggcggcaccgcccgccccgctcagtccggcgcccgcgtcgaccccgtcgccgagcccgtcagtgggcaagcatcaccatcacggccagccacccgcggtggcgccggtgaatccgaatcagtgaatcagtgccggcggtggaagccgtcggcgtccgacgtcgcctcgttgagtgaggcgtcggcgtagccccggcagtaatcccacgtcacgtaggcgtccggctcggggtcgtaggcgggctcgtgcgggcgcacggtgccgtcgatcaacagctgcagcaggttggcccgcagcatgtcccagtcgtggtagtggtcctgctggcactcgtcgcagcacaccacgagtccgcgaatacccttgtgtgccagcagcgcctcgtacacggccagatcggcgaggtcggcctcgacggccatccgctcctgctgatccagcggctgtcccggctcgacggcatccagcgccgccgacggatcacaggggtcgtcggcgaaaggatcgggcggcaaacccggtgggaggtggtcgcgcacgcctctagcctacgcagcccggccgggataacgccagcagggagcaacccgccgttccggttccgtttggcccgcacggcgcgcccgagcaagcggactgccggggcggccgagccgataggatgggtctctcaccccgcatcgtatggaggaccccactgatgacccgtggcacgtcccacctggaagacagctctgacctggttggcagtgcgtacgtgcgggtgggtggcctcgtcgacgatccggtgcccaccgggggcgacaacccgcacaagatcgccatgctcggcctgacgttcgacgacgtgctgctgctgcccgcggcctccgacgtggtgcccgccaccgccgacacttccagccagctcaccaagaagatcaggctcaaggtgccgctggtcagctcggcgatggacaccgtcaccgagtcgcggatggccatcgcgatggcccgggcgggcggcatgggcgtgctgcaccgcaacctgccggtggccgaacaggccggccaggtcgagatggtcaagcgctccgaggccggcatggtcaccgacccggtcacctgccgccccgacaacacgctggcccaggtcgacgcgctgtgcgcgcggttccgcatctccgggctgccggtggtggacgactccggcgcgctggtcggcatcatcaccaaccgcgacatgcggttcgaggtcgaccagaccaagaaggtcgccgaggtgatgaccaaggccccgctgatcaccgcccaggagggcgtgtccgccgacgcggcgctggggctgttgcggcgcaacaagatcgagaagctgcccatcgtcgacgggcacggccggctgaccgggctgatcaccgtcaaggacttcgtcaagaccgaacagcacccgctggccaccaaggacagcgacggccggctgctggtcggcgcggccgtcggggtcggcggcgacgcctgggtacgggccatgatgctggtcgacgccggggtggacgtgctggtcgtggacaccgcgcacgcgcacaaccggctggtgctcgacatggtcggcaaactcaaggccgaggtgggcgagcgcgtcgaggtgatcggcggcaacgtcgccacccgggccgcggccgccgccctggtggccgccggcgccgacgcggtgaaggtgggggtggggcccggctcgatctgcaccacccgggtggtggccggcgtcggcgcgccacagatcaccgcgatcctggaagccgtggccgcctgcgggccggcgggcgtgccggtgatcgccgacggcgggctgcagtactccggcgacatcgccaaggcgctggccgccggcgcgtcgacggccatgctgggctcgctgctggccggcaccgccgaggcgcccggcgagctgatcttcgtcaacggcaagcagttcaagagctaccgcggcatggggtcgctgggcgcgatggccggccgcggttccggcgccggcaagtcctactccaaggaccgctacttcgccgacgacgccctctccgaggacaagctggtgcccgagggcatcgagggccgggtgccgttccgcggcccgctgtcctcggtgatccaccaactcaccggcggcctgcgggcggcgatgggttacacgggctcgccgaccatcgaggcgctgcaacaggcgcagttcgtccggatcacggcggcgggcctgcgggaaagccacccgcacgacgtcgccatgaccgtcgaagcccccaactactacgcgcgctgaggcccacatggtcgagatcgggatgggccgcaccgcccgtcgcagctatgaactgagcgaagtcagcatcgtggcctcccggcgcacccgctcctcgcaggacgtgtcgacggcctggcagctggacgcctaccggttcgagatcccggtgctggcgcacccgaccgacgcgctggtgtcaccggagttcgccatcgagctgggccgactcggcggcctgggcgtgctcaacggcgagggcctgatcggccggcacgccgacgtcgaggccaagatcgctcagctggtcgaggccgccagcaaggaacccgaaccctccgcggcgatccggctgctgcaggagctgcacgccgcgccgctcaaccccgacctgctgggctcggccgtcgcccgcatccgggaggccggggtgaccaccgcggtgcgggtcagcccgcaaaacgcccaggcactcaccccggtcctgctgcaggccggcatcgacctgctggtcatccagggcaccatcgtctccgccgagcgggtggctagcgacggcgagccgctgaacctcaagaccttcatctccgagctcgacgtgccggtggtcgccggcggcgtgcaggaccaccgcaccgcgctgcacctgatgcgcaccggcgccgccggcgtcatcgtcggctacggcgccacccgcggcgtgaccaccagcgacgaggtgctgggcatcagcgtgccgatggccaccgcgatcgccgacgccgccgccgcgcgccgggagtacctcgacgagaccggcggtcgctacgtgcacgtgctggccgacggcgacatccacacctccggcgagctggccaaggcgatcgcctgcggcgccgacgcagtggtgctgggcaccccgctcgccgaggccgccgaggcgctcggcgagggctggttctggccggccgccgccgcgcacccgtcgctgccgcgcggcgcgctgctgcaggtcgcgatcggggagcgcccgccgctgcgccaggtgctcaacgggccgtccgacgacccgttcggctcgctgaacctggtcggcgggctgcgccggtcgatggcgaaggccggttactgcgatctcaaggaattccagaaggtgggcctgacggtcggcagctagtcgcgccttgaggcgcccttgcgccgccaccggccgagcgtcacgctggcgtgacggccggcgccgagtgtcacgccagcgtgacgctcgggcgcggcggccggaggcccctggcttgttaccggcgggtaaggccatactggtgcgatgaagccggattacgacgtcctgatcatcggttcgggtttcgggggcagcgtcagcgcgttgcggctgaccgagaagggctaccgggtgggcgtgctggaggccggccgccggttcgccgacgaggatttcgccgagacatcctgggacctgcacaagttcctgtgggcgccgaagctgggctgctacggcatccagcgcatccacccgctcaagaacgtgctgatcctggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttccggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatctcctttccgctatccggcagcgtaatccggcctcgggctgcggcatgctggagcgctgcacgaggctggaaatcgtgcgcgacggaaaggaccccagcacccatgagccagtcacttacggacaaggtcgcgctgatcaccggggcggcgcgcgggcagggccgcgcgcacgcggcgcggctggccgccgagggcgccgacatcatcgccgtcgacctcgccgggccgctgccgccgagcgttccctacgactcgtcgacgcccgaggacctggccgagaccgcggaactggtgcgtgccgccggacggcgggtcgtcaccgcacagaccgacgtgcgcgacctggacgccctgacctcctcggtggacacggcggtgggcgagctcggccgcctggacgtcatcgtggccaacgccggaatctgcagccccgccccgtggaatcggatcaccgcgcaggcgttccgggacaccatcgacaccaacgtcgtcggcacctggaacaccgtgatggcgggggcgcagcacatcatcgacggcggccgcggcgggtcgatcatcctgatcggctcggcggccggcatcaacatgcagtcgttcatggtccactacaccgccagcaagcacgccgtggtgggcatggcccgcgcgttcgccgccgaactcggccgctacaacattcgggtcaacagcctcaaccccggggcggtcgccaccccgatgggcaccggccggatgcgcgacgcgctgcgcgcggccgccgacgactacccgcatctgcggggcctgcacaaaccgctgctgcccgagggcatcgcgcaaccggaggacatcgccgacgcggtggcctggctggcctccgaccaatccagattggtgaccgccagccaggtttcggtcgatctcggcgtcggctacgtgtgatgcccgcccgcgcccctcgccccgcgcggccgaccaggcacaatggtgtggtcaaaacctgcggcggggagcgagaaggagcggcatgcccaccagcgaataccaggtgagcgggatgagctgcggccactgcgaggccgccgtgcacagcgaggtggcccgcatccccggcgtcgacggcgtctcggtcagcgcggacaccggccggctcgtcgtcaccagcgcggtgcccatcgacaccgacgccgtcctcggcgcggtcgacgaagccggcttccaggccgtcttggtcgcatgagcacaccgccacggcacgtcgacgaggggaccttccccgaccacaccgcctcaaccgctcgcatcgagctggagatcaccgggatgacctgcgcctcatgcgcggcccggatcgaaaagaagctgaacaagctggacggcgtcacagcgaccgtcaactacgccaccgagaaggccgcggtcagcgcgcccgcgagttacgacccgcaaacgctgatcaccgagatcgaaaacgccgggtacgccgccgccgtggcgaagccgtcgccgccgcgggacgacccggagctcgcctcgctgcgcaggcgcctggtcaccgccacagccctggccgggccggtgatcgccgtggcgatgattcccgcgctgcaattccagcactggcactgggcggcgctggccctgaccgcgccggtggtcgggtggtgcgggcgccccttccacgctgccgcgtgggccaacctcaaacatggcgtcgccaccatggacaccctgatctcgatcggcacgctggcggccttcctgtggtcgctgtacgccctggttctcggggcggccgaccggcccggcatgcggcacgacttcgagctgaccgtcgggcacggcgcccacgtctcccacgtcgcggccccgtgccacgtctacttcgaggtggcggccggggtgacgctgttcgtgctggccggccggtacttcgagcggcggtccaagcggacggccggcgccgcgctgcgggcgctgctggcgctgggcgccaaggacgtcgcggtgctgcgggcgggcgccgaaacccgcatcccgatcgagcggttggccgtcggcgacgagttcgtggtgcgtcccggggaacggatcgccaccgacgggatcgtcgtcgcgggctcctcggcggtggacgccgccatgctgaccggtgagtccgtcccggtcgaggtcggcgtgggcgacggcgtgaccggcggcaccgtcaacgccggcggccggctggtggtgcgcgccaccgggatcggcgacgacacccaactggcccggatggcccaactggtcgaacgggcccagtccggcaaggccgacgcgcagcggctcgccgaccgcgtctcgggggtgttcgtccccgtcgtgctgctgctcgcggtggcaaccctggccggctggctgacggcgggcggcaccctggccaccgccctgaccgcggccgtcgcggtgctcatcatcgcctgcccgtgcgcgctgggactggccaccccgaccgccctgctggtcggcaccggccgggccgcccagcttggagtcctgatcaaggggcccgaagtgctcgagaccacccgcgccgtcgacaccgtcgtgctcgacaagaccgggaccgtcaccaccggcgccatgaccgtgctcgacgtggtcgccgccgacggcaccgaccgcgccacgctgttgcgctacgccggggcgctggaggccgcctccgaacaccccatcgcgcacgccatcgcccgggacgccaaggcggaactcggcccgctgcccacccccaccggcttccgcgcggtcggcggcggcggcgtgcacggcagggtggacggccacgccgtcgcggtcgggcggccgaggtggctggccgagcgcggcctgcgcccggacgccgccctggcggcggccgccgcgcgcgccgagcacgacggcaaaacggtggtcgccgtcggctgggacggccgggcgcgcggcatcctggcgctggccgacaccgtcaaaccctgcagcgccgcggcggtgcggcagttcacccggctgggcctgacgccgatcctgttgaccggcgacaaccacaccgtcgcccgccgcatcgccggcgagctcgggatcggcgaggtcatctccggcgcgctgcccgccgacaaggtcgaggccgtcaagcgcctgcaatccgcgggccgggtggtggccatgggcaccggcaccgacgtcgcgatcgaggccgccgacgtcaccgtggtccgcggcgacctgcgcgcggccgtcgacgcgatccggctctcccggcgcacgctggccaccatcaagaccaacctggtgtgggccttcggctacaacctggccgcgattcccctggcggcgctcggcatgctcaacccgatgctggccggcgccgccatggcgctgtccagcgtgctcgtcgtcggcaacagcctgcggctgcgctcgttcgccagcatcatccccggcgcgtgagccgcgcagcatcggccggccggcggcgccggtatgggatagttggtcgggccgccgctttcggtcatcccggccgaccggtcgaccgccacctccccctcgcgcagcgctcgatctagcaaaaggtcacgaccgttggagcagttcttcggacaactgtcgctgctgcacggctggctgccgccgaccgtgcagggcctggcgctgctgatgctggtcgccgcgatccactggcgggcccgcggctggctcaagcgggtgctgccggcggcgctggtcgccgcggtcgcggtgaccgtgctggcgcgctggtacatcacctcgctcggggtggccggggatccggcgccgacggcgctgtggttctggatcgcgctgagcggtctggccgcggccgtgttcctggtgggctggcggggcgtgcgctggtggcgacgcgggctggcggtgctgtcgataccgctgtgcgtgctgtgcgcgggcctggcgctgaacggctgggtgggctacttccccaccgtgctcgcggcgtggaatcagctgacccaggcgccgctgcccgaccagatcgaccggctgcgggtcaccgagatgcagatcgccggcaccaggccgagcaagggcgtggtggtgccggtggacatcgacggcaacggcccgtcgggctcacacttcgcgcaccgccgcgaactggtctatctgcccccggcgtggttcaacagcaaccccccaccccgattgccggcggtcatgatgatcagctcggccttcaacaccccggccgactggctgggcccgggcggcgccttcaccgccatcgacaacttcgccgccgcccaccacgggttcgccccggtgctggtgttcgtcgatcccaccggctcgttcgacaacgacaccgagtgcgtcaacggcagccgcggcaacgccgccgaccacctgaccaaggacatccagccgttcatggtgtcgaacttcggcgtcagcgccgaccgggccaactggggcgtcgccggatggtcgatgggcggcacctgcgccgtcgacctggccgtcatgcacccggagatgttccgcgccttcgtcgacatcgcgggcgaccgcggccccaacgtcggccccaaggaccaatccgtggcgcggctgttcggcggcgatcaggccgcgtgggcggccttcgacccggtcacggtgatgaccaggcacggtcgctacgccgacttgtccggttggttcgaggtgcccggggccgacgtggcgcgcaccgcgcagcagggcaacgccgatccagcacccgccctggtggcgtccagcagcgacccggccgccaaccccgagggccaggatgccgccgcgcactcgctgtgcgcggtcggcgccgccaacggcatcgcctgcgcggtggtcacccagccgggcaagcacgactggccgttcgccgcccaggcgtttgccaccgcgctgccgtggctggcctggacgatcggcacgcccaacaccgaaccggtgcagctgccgcagcgggccgccgcgccgccgcggtgattccggcagctgggctgtctcggggcgacaggcaacaaattccccataattcacagctgacccacccgtaacggagccgccggatcggcggcccgaatggtacggttcgctgctgtggcctcgatgtttcgccccggcaacggtcccggcagggacgcgctcgtcggccggtgcgccccggggccgaacccgccgtggccttgccgccggatgatcgccgccccgcctgtccagccatgaaccgccgccagttcctcggatcgctcgccgcctcggtcgtggccggcgtcggcgccgcgcggctcatcgtcgatccgcaaccgcgcaccttcgcccagacgccggcggccgccataccgacgtccggcccgaccgccccgcaggccctgctgccgcctcccccgctgagcgcccgcatcccgctgcccggcggcggcgcgctgatgaagatcccgggcgagggcgacctgctggcgctgaccgtcgacgacggcgtcaacagcgaggtggtgcgcgcctatacgcagttcgccaaggacaccggcgtgcggctgacctatttcgtcaacggggtctacgactcgtggaccgagaacctgcagttgctgcgcccgctggtcgacagcggccagatccagctcggcaaccacacctggtcgcacccggacctgacgacgctgaccaaagagcaagtggccgaacaactctcgcgtaacgacgcgttcctgaagaagacgtacggcatcggcgccaagccgtactggcggccgccgtacgccaagcgcaacgccgccgtggacgccgtggccgccgacctgggctaccaggtgccgacgttgtggtcgggctcgctgtcggattcgacgctgatcaccgaggactacatcctgcagatggccgatcagtacttcacgccgcaggccatcgtgatcgggcacctcaatcacctgccggtcacccacgtctacccgcagctggtcgacatcatccgggaacgcaacctgcgcaccgtcaccctcaacgacgtgttcctcaagacgccgtaaggcgcattacccgccgggctcccgctcggcggccagcagcaccgtcagcgtctcgcgcaactcggtcagccgtcgctcgccgagcaccttgcgccaccgcttctccatggcgatcgcgttggcgcgcatcacctgcagtgcctgccgaccccgcggcgtcaactcgatgatccgggcccgcgcgtcggcagggtcgggcgtgcgggtgacatagccgtgccgctccagggccgcgaccgcctgggccaccgcctgccggctcacccgcagccggtcggccagatcggaggcgtgcaatccgcccgcggccagcggcaccagggcgagcgactgggcggggcggatcccgtcgaggccggcctcggcgaacgcggcgcgcagccgcggtgcgccggcggcggcgaccaggttcaccagcgccggcacggtcggctcccacccgccgcgcgctccctctcgcatgccgatcagtctgccaccccgggagggattgacaagttacttgtcaaaatgcccgccggctgccaccatggccctatgcgattcggatgtgcccgggcggtcaacctcggcctgctgccggttctggtcgtcgtgctcgccggctgcctcgccggcgggcatgcgctgggaacgcctgactcccaatcgattccggtcgggccatccacccacaccctgcagtcgggcggcacgccccgcagctatcacctgtaccggccgcaggggctgagcgaggcggcccccctggtggtgatgctgcacggcggctttggcaacggcgagcaggccgagcgcgcctaccactgggacgccgaggccgacgccgggcatttcctggtcgcctaccccgacggcctgggccgcgcctggaacgccggaacctgttgcggtgagccggcacacgccggcaccgacgacgtcggattcgtcaacgccgtggtcggcgccatcgcggcgcagatcccggtggatcgtgcccgcgtctacgtcaccggcatgtcgaacggcgccatgatggcgctgcggctgggctgccagagcgacaccctcgccgcgatcgccccggtggccggcacgctgctcaccgattgctccgcggcccggccggcctcggtgctgcagatccacggcaccgccgacgaccgcgtgccctatgcgggcggacccggaaaggcgttcgcgctcaacggctccccgcgggtcgacgggccgtcggtggaatccgtcaacgccacctggcgcgccatcgacgcctgcgggccgcccagctcgaccaccgccggcgatgtcaccacccagaccgccggctgcgcggacggccgcacggtggagttgatctcggtggccgggtgcggccaccaatggcccggcggggcgcccagccccctggcggaaaaggtggccggaattccggcgccgtcgacggcgctggacgccaccgacacgatctggcaattcttcgcccgtaatcaccgttagcgagcggccaatctctaaaaaattagagattggtcttccgctggtcgtgcgcgattgttaccgttccgtaatgcgccgcgtcgcgggagttttcgcagcactggtgttgatggcgggcaccctgaccggacccgcgatcgcgcgggccgacggcgacgagccgcaatacgccgacttctacaccccgcccgatccgctgccgcccgggcggccgggcgacctgatccgcaccgagccgtcgcggctggtgctggagccctccggccagctcggcgccatcatggccaccgggacccggatcatgtaccgcagcaccgatacccgcggcaacccgatcgcggtcaccggcacctacttcgagccctacaacgattggccgtacggtgggccgcggccgttgatgagctacgcgcccggcactcagggccagggcaatcagtgcgccccgtcgcgaatgttcaaccagggcatccattattcgggcggctgggacatcatgttcaactacgaggagctgttcgtggccaccatggtggcccgcggcttcgccatcgtgatgaccgactaccagggcctgggcacgccgtcgatgcacacgtacgtgggccgggtggccgaggggcaggccgtgctcgatgcggcccggaccgcgatgcgactgccaggcacctcgctggatccgcatgggccggtggcattttggggttattcacaaggcggcggcgccaccgcgtcggcggccgagctggccgcgcaatacgcgcccgacctgcacatcgtgggcacctacgccggcgcgccgccggccgacctcaaggagctgttgccctacgcggacggcagcgcgctggtcggcgtggtcgggtacgcgctgaacagcgtgatggccgcctacccggaattcgccgacgccattcgttccaagatgacgccgcgcgggctggcgatgctggaatcggtgtcccgccagtgcgtcggacaaaccctgctggacttcatgtttcgccacattcagccctacttcaccgaggacatcaatcaactggtcaacgaggagccgttcaacagcctgttcgaggcgcagcggatcgggcgctacaaacccaacgcgccggtgctgatcaacagcaaccgctacgacccgctggtgccgtggacggccgccaatcagctcggccgcgactggtgcgcccagggcgccgacgtggagttccgcaccaacgaggagccgcccttcctcaacaagctcgtcatcaaccacgcgctgccgatgctggtcgacggcgagccggccatgcagtggatcgccgcccgcttccgcggagaacccaccgcgcccaactgcggccagttttagactggggtgcatcgctgcccgcagaaagcacaacgccgcgcagcggcgccgccaactcgccgacgccgcaatcgaattgctgggcggcaacgggctgcacggtgtcagccacccgaaggtcgacgaccgcgccggcgtcccggccggcaccacgtcgttctacttccgcacccgcaaggcgctggtgcacgccatggccggccggctggccgagctcgacgtcgccgacttctcgatgatggccgagctcgccgaggatcacgccaccgagttcgccggcaccgccgggttggcccgcatcgtcatgtacgtgaacagcgagccgtggctgacccgtgccaaggcgcgctacgaactcgcgctgctggccggccgggacccggaactggccgccgcgctcagcgagtcggcggaccggctctacgcactggcccgcaacgtcgtcacccagtggcatccggccggcagcgcaccggacccggcgctggtcgacgaccaggcgaccgccaccctggcgttcatcaacgggatcatgctgaccttcgtcgccggccagccggccgtcgacgatgccgggcaactcgaccggctcatccagggcgtcatcgccggcgtcgcccacgtccgcggtgcgtaaacgaaaccgcgtgtccgacaaggcattcggctcgcgcgccggtcagcgtgcgtcgaacatcccgtcgaccagccgctgcagcacctgccgggtctcccggcgggcgcggtccggatcgtccgcggtggcgatcaccatggccgcctcgtcgagcgcgccgatcagcacgtgcgccagcggacgcaccggttgctcggccaactcgccggcccggatcgcctcggtgagcagctgctcggtcatgcccaggctgtagcgctgcgcgacatcgcggaattcggcccagcccagcacgctcggtgcgtccagcaggataagttgccgcacttcgggatcggcggacacctccagccaggcgtcgaccgcggcgcggatcgcgtccgtgggcgtgctcgccccggattcggccaccaccaccgccatccgcgccatcacatcctgctcgacggcctcgaccaccgcgcggaaaagcgctgccttgtcggcgaattggtggtacatcgcgccccgggtgaccccggcggccgcggcgatctcgggggtgccgacctcggtgtagccgcgcagcccccacagcttacgggcagcggcgatcagcgcgtcgcgggtcgccgcggagcgctcttcctgggtccgtctcttgctttccatacagtctgttggtaacttacgaacagacagcctgtttgtaagtgtacttcctctgagctaggagttctccatgtcgacgatcgacattagtgccggaaccatccattacgaagcaaccggacccgcggacggcaggcccgtggtgttcgtgcacggctacctgatgggcggccaactctggcgtcaggtcggcgaccggctcgccggccgcgggctgcgctgcatcgccccgacctggccgatgggcgcgcacccggagccgttgcgccgcggcgccgaccggaccatcaccggggtggccgccatggtcgccgagctgctctccgcgctggacctcgaggacgtggtgctggtcggcaacgacaccggcggggtggtcagccagctggtggccgtgcaccaccgcgagcggctgggcgcgctggtgctcacgagttgcgatgcgttcgaacactttccacccccggtcctgcggccggtgatcctggccgccaagtccaaggcgacgttccgcgcggtggcccaggccatgcgcgcacccgcggtgcgcaagcgcgcgttcgacggcctggcgcacagcaatatcgacgcgctcaccgagctctgggtgcgcccggcgctctcgctccccgcggtcgccgaggacctgcgccggttcaccctgtcgctgcgcaccgaggtgaccacggcggcggcgacgcggctgtacgacttcgacaagcccacgctgatcgcatggtcggccgacgacgtgttcttcgcgcaggaggacggcgcgcggctggccgcgacgatcccgaacgcccgccacgaggtcatcgcgggggcgcggaccttctcgatggtcgatcagcccgaccggctcgccgatctgttgtcgacggtcgcggtgcgcacctgaggcattgcggttcacgcgcgtaaccccacggcgaaatctcgttgggattatcgccgtggggttacgctcgcgggcgtgacagacgagctgcggggccggcggatcctggtgaccggcgccgccaccggtatcggcgcggccgccgtcagcgtcctcaccgacgcgggcgccgacgtcgtcgcgacctatcacacgacgccaccgccgccggatctgacggcgcactggttgcagtgcgacgcgcgcgacgccgacgccgtctcggccctggtccaccgggccgccgagcacctgggtgggctcgacgtgctggtgcacgccgcggggctgtggcagccggggatacccggctgcatcggcgccgacgacatctcgtttctgttggacaccaacgtcaaggcgaccatcctgaccaatcaagccgcccacgccgccatgaaggcccaagaccccaagggcggccggatcatcaacttcggctcctcggaagccgttatgggcagcccgatttcggccgtctacgccgcgaccaagggcgcggtgcaggcctggacccgctcggcggccaaggcctgggccgccgaccacgtcaccgtcaacgcccttgccccggcggtgcagacgccgggcgccgaccggctccgcgcgttcctcggcccggacgccgccgcgctgatcgaccagcagatgcagatgatgatcccgctgggtggcgcgctgggcgagccggcccgcgacctcgggccgatgctggtgttcctggccgggtccgggtcgggcttcatcaccggacaactgctggccgtcgacggcggcctgatgatggtgggcgcatagcccgcccgcccgccgccgctcggccgctactataagacggaccgtctcgtctcgcagggcaggcatagtgaaggtggggccgaccgatggctgaggacacgatccaggcgctgctgcgcaaacggtggtccgaccccggtgtcgcggtgaaatacggtgacacgcaatggagttgggcccagtatctgcgggacgcggcggcccgggccgcggccctgctgggcgccgccgacccgggacggccgatgcacgtcggcaccctgctgggcaacacccccgagatgctgagccagatggcggcggccggcctcggcggctacgtgctgtgcgggctgaacaccacccggcgcggcgaggcgctggccgccgacgttcgccgcgccgactgccagttcgtggtcaccgacgccgaacaccggccgctgctggacggcctggaccttgtcggcacgcagatcctggacacctcgacgccggactgggccgggttcgtcgacgccgccggagagctgaccccacatcgggatgtcgccgcgatggacccgttcatgatgatattcacctcgggcaccagcggaaaccctaaggcggtgcaggtatcccatttgatggcggtgttcgcggggagcaatctggtgcagcgcttcgggctcaccgaacacgacacctgctacgtgtcgatgccgctgtttcactccaacgcggtggtcgcgggatgggcgcccgcggtgtgctcgggggccgcgatcgtgccggcgaaattctcggcgcgcaacttcctcgacgacatccgccgctacggcgccacctacatgaactacgtcggcaaaccgctggcctacgtgctggccaccccggagcgcgccgacgatgccgacaacccgctgcgggtggcgttcggtaacgaggccaacgacaaggacatcgaggagttcggccgctggttcggtgtgcaggtcgaggacggcttcgggtcgaccgagaacgccgtcatcgtgatccgcgaacccggcaccccgaggggctcgatcggccggggcatcgacggggtggcgatctacaacagcgataccgtcaccgaatgccccgtcgcccggttcgacgccgacggcgccctgatcaacgccgacgaagcggtgggcgagttggtgaacaccgccggttccggtttcttcaccggctactacaacgaccccgacgccaacgccgagcgcatgcggcacgacatgtactggtccggcgacctggcctaccgcgacgccgacggctggatctacctggccggccgcaccgcggactggatgcgggtggacggcgagaacctcgcggccgcccccatcgaacgaatcctgttgcggcacagcgcgatcaaccgcgtcgcggtatacgccgtgccggacgggcatgtcggcgatcaggtgatggccgccgtcgtcctcaacgacggggaaaccctgaccccggccgcgttcgaggcgttcctggacgcacagcccgacctgtcccccaaggcccggccgcgctatgtccgcatcgccgccgacctgcccagcaccgccacccacaaagtgctgaaacgccaactgatctcgcagggcaccgcggtagccgccggcgaggtgctctgggagcgcgagccgcgcggcaccgcctacacggtggtggctagcccggactgcggggtgcccggcgacggatctgccccttcgaccgtcgcacccgtttgaccgggtcgcggctggtgccgccggcgatctcgtcgcgcagctgggagatgttggagatctcggcgtacagcccgcggatcgcgtagtccagcacggcgaaggagaaccgctgctccgggtccgcggtgatgccgagttcctgcgaccgccgccgcgaccacagcgcctcgtcgagccgggcccgggtggcgtccagatgccgttccagggtgtcgacgatgcgttcgggatcctcgccgcgggccagccaggtcttgaggatgacggggtgtttgatcaccacctggtcctgccccgggaaatgctgcacccaccggcgcagcgcgtcgcgcccggcgtcggtggtctcgtacaaggtgatggcccgcttgccggattgcgagccggtctgggcgaccatgccgcgggccagcagccgggtcagttcgcggcgcacgtggctgaccgacggcgaccagtagaagtggccgaccgacagttcggcgcgcatcttgatctcgccggcggtgagtcgctcgtcgttggccgccagcacgccgagcaccaggtaggcagtgaccggcagcccgttgctggttcgggggctcacgaaccgtccgtctcgtcggtgaagtacggcagcgtcacgtcggctgcgacggtgtggaactgcacccgcacccgcagcccgacgcgcaggtcgcccggcggcacgccgacgacgttggtgagcatctggtagccctcgtccagggtgatgatggccggcgcgttgggcgggatgaactccgcggtcaccggccgatgaaccacggtccagctgtagatctcgccgcggccgccgctctgctgccagccgatgtcgtccgaaaggcactggcggcaatgctcggtcggcgggaagttggccagatcgcaagcgcggcaccgctgatagcgcagctgccgtgaccggcagccctcccagaacggcacgctcagcgggctgctggcgtgcggcaccggcccggtctggggccgcaacggctcggcggtcaccgcggctcgtcccccaggatcagcacggtggtgaacagtgcaccggctcccccgttgctgcacaaggcgatatgggcgtcggggacctgcagctcgccggcctggccgcgcagctgttgcacggcccggatcgcccgctgcatcatctgcggattggagcccgcgtggctgaacgacatggttcctccgtcggtggtgaccgggtggctgccgtcgagggcgatgtgcccgtcggcgacgaacggcccgccttcaccgtcctcgcagaacccgaatgcctcgagctggcggatgatttcgaaggagaacgggtcgtagagttcgagcacgtcgacgtcgtcgcggcgcagcccggcgtgggcgaaggcgcagtcggcagcccgccggcccaccacgccgttcacgtcgccgccgcgccggcccgccaggtcgaaggccggcgggtgctggtaggacgggccgtggaagtccgcgccgctgcccagcacgtagatgggttggcttgcggtgtcgaccttttcgaggttggccagcaccagcgcgcagccgccctcggaggtggtcgcgcagtccagcaggtggaacgggtcggcgatgggccgcgacgcggtgatgtcgtccggcgtgaacgggccccgtcggtagtagacggcctcggggttgcgtgacccgttgttgcggatggtggccgccaccgtcgagagttgttcgcgggtggtgccgtagacgtgcatgtgccggcgcgcgatgagcgcgaactcggcggtggtgaacatgccccagggggcgacgaattcgttctccggccgggtccacggcgcggtggcctcgtggtcgcggtattcaccggcctgggacgcgaccagcaccaccacctcggccatgccgtgttcgatggcggtggccgcctcggtgatcatgccgaccccgaacccgagcccctgccacgccgggcccagtcgcaggtcgtagatcagcgcggtggacagcgggccggcgctgatcccgtcgacgtcgtcgaggcacagcccggcgtcgtcgagggcgccccgaatggccttgagcgccaggctgcgtgacgtttccccgtccaggcgccggccttgccgggtgttgtgcacgccgacgatcgccgcggtgcgcttcgccggtctagttttcatccgccactactccgagataggtgcccacgacgtcgaatcgtgttccgtcgcggtcgatttcgccgatcagtgtgcagcgggaatccgctcggggcgcgcccttggccaggacatcgatccgcacgtccaccggtcgggccgtctgcgggtcggtgatctcgacgaccatcgccaccgcccgcttatcggggtcccactcgacgccggtgatgcggtgccgggcggtcagctcgatcaccaccgagtcccggcgcaccaggaagcgcaccgctgcgcacaactcgccggcgtggggcggaacgcacaggctgaccgccatgtcacaggcccgccggccggtcgctgatggttcccgatgcccgcagctcggccaggtcggcgtcgctgtgccccagcagctcggtgagcacctcggcggtgtgctcgccgtagcgcggcggcacccggcgcagccagcgccgcggtttgccgaggaacgcgaaaggcattccggtgcacaggaaggtgccggcgacgggatgatcgacggtctcccagaagccgcgggcgtgcagctgcgggtcggccagcagcgccgcggccggtgtgacgggcgcggcggccaccccggcggcgcgcagcgcgtccaccgcgtcggccaccgtacggcccgcggcccagtccgagatgagcttgtcgacgtcgtcggcgtgctcgtcccagccggtgtcgcccggctccgcgcggcccagcagccgggccagcgacgcgcgggcggtgtcgtccagcgccgccagcgccacccacgcgtcgtcaccgcggcaccggtacacgccctgcgggctggcgcctggtcctcggtttctattgcggcgcagcgcgattccgttgcgcgagtattcgaccagcatctcggccgccacgttcagcgccgcctccaccatggtcgcttccacctgcatgccggtgccctcgcggtcgcggacggtcagcgcggccactgccgcgaaagcggcgtgcaggccggcgatcgggtcgcagacgccgcgcggaatcaccggcgggccctcggggtgtccggtcatccaggccatgcccgtcgcctgctccatggtctgggcgaatccgacccgatcgcgccacgggccgtccaggccgaaggcgggcatccggatcatgacggcgcgcgggttggccgcgcgcaccgcgtcccattccaggccgaagttcgccatcacccggggcgagaagttctcgacgacgagatcgcctgcggcaatgagccctagcgcgatgctgcgtcccgcctcggtgcccaggtcgacgctgatgccccgcttgttgttgttgctgcacaggaagaccgggccccactcccaccactggtcccagtcgggcgggcggcccgcggagaaccgcatgccgtccggccggcgcactccctcgatcttgatcacgtcggcgcccagggcgcccagcagttgggtggcgaccgggccggcccagaacgcggtgaggtcggtgacccggatgccggacagcggaagggtgccggcgtcctcgccgcgggccggctcgggccggggcggccagtgcacccgcccgttgtcggcgcccaacgccggcggctccgacggcggccgggtggtgatggcgtcgctgcggtagggcacccgcggcgccagcacaccggccggggactcgacgaacacgacgcgttgcacgaagtggtccagcttggccagtgtctcgggattggcgatgggcgccaccgggattcggaacgccaccgccaggtcgacgatctcctgggtggtgcgggtgcgggtccacccggtgaccatgtccaggaattcgtcgcggcgcgcgacgcggccggcgaaggatgccagctcggcgtcgtcgacgaggtcggcgcggtcgatcatcaccagaaaatcctggaactgctgggcggtgatggtgcagaagccgaccatgccgtcggcggtggggacgatcgagggcagctccaaactgcgttcgtgcagcagcgaatcggcccccagcacgctcgccgacatggcggacagaccgcccatggcgatcaccatggcctcgtaagtcgagacatcgatcacctcgccgcggccggtgcgggccgcatgccgggcggtcgccgccgcggccgccgcggcgaacgtgcccgccagccattcgcccagccggccgccggcctgcaccggctcgtcgcccggccagccccgcccggcgatcgacccgcacagcgcctgcagaatgaactcgttggccaccacctgctggtcgacgtaggggccggtggtgccgaacggggtgatcgccaccaccaccgccgaaggcccggtgcgcccggtgagttcgtccagcgtccagccgtcggtgaggtcggtgagcaccaggtcggcgccggccagcagcgccgcgacctcggcccggccgcggccgaccaccgacctcttgccggcagccagatagccgaacagcgccccgggcggcccgcccgccgaccagcggcgcatcgaatccccttggggggactccactttcaccacgtcggcgccggcgtcggcgaacatcttgccgcagtaggagaccgccaggccgttgctgaactccagcacgcgccagtgcgcgaacggcgccgggcccacgctcagttgcccaatgtggtggcgcggccggcgatcccggctgcctcgaccgtcaccggcgcctgggctgacgcctgggcctgcagggcgaattgcgtcatcctcgcccacgcgtcgcggtcgcgctggctggcccggtgcccgacgtgggtgaccacgtcgacgtcggtcgcctgggcgcgcaggtgaccggcccgggcctgctccttcgggatgtgccgaaacgggtcgaatgagtaggcggccatggcgttttcgtgggtgatcttgttgatcaccgcgtcgtcgaggtggcccatggtgtcgatgacgtcctccggcgcgaacggccagttgctgtcggagtgcgggaagtcggactcccagcacagcatgtcctcgttgaaccaatccatgttgcgcacaccgactttgtcgctgatgaagcaggtgtagaagtgtcgtttgaacacgtcggtggggccgctgtagccgggcgggaaggtggccagcgtccagcccgaatggcggttgtagacgtgctcggcccgccacaggaagtacggtatccagccgacgtcgccctcggtgagggagaatttcagctccgggaagtccgcccagaactgcgcccagatcagctcggtgaaggtgaacatgctcatcatcgacgaggcggtcatctgcacgctgggcggggcgtcggtcgacacctgcggggaccgcgacgccgagcccacgtgggtgcacagcaccgtcttgttctcgcagaccgcctcgaacaacgggtaccaataccgggtgtgaatgctgggcatctgcaacgcttccgggttctccgagaacgtcaccgcgtgacatcccttggcggccaagcggttgacctccttggcggcctcggccacgtcgaacagcggcaggatgccgcacgggatgaaccggcccgggtacgcggcacaccactcgtcgatgtgccagtcgttgtaggccttgatcatcaccaggttgacctcgcggtccggggcctggttgagcacctggccggagaacccggtgaagttggggaagttcaggcccgccagctggccgccggcgttcatgtcgcggacccgctcgtcgacgttgaagcagcccggccgcatctcgtcgtagcggctggcgtcgatgttgtacatctcgcgcggcttgcccgccacggcgttcaggcccatgttgcgtccgtggatgtcgccgtagtaccactgctggatgccgtcgggctcgacgaccacccgcggcgcgcggtccttgtacttggcggggacgtgggcgtcgaacatgtcggccggctcggcgatgtggtcgtccacgctgatcaggatcagatcgtccttgttcatgccgtgctcctcggtcaccgactagtgactagtagacaatggtgccgctcgcagtgtcaacggcggccgtcgcgtcacgcctcccaactcgccgccgtatcgcccggcagggccggcgatttccgccggaacggcggcgcgcccgcgggtcggccgggagcgcgcaggcccgtcgtctttgggactattagtctctatgctggcagggcggtcgcggccggccgcgccgcgcgggcgcgcgggcatgccaccatgaggcatgaccgggccgcaaggtaacggaaattcgagcagcaacaaggcggcgcgtccgaccaccgccgacgtggcccggctggccggcgtgtcgaccgccaccgtcagttacgtgctgaacaacgcgcggggccgccgcatctcgcccgacacccgcgacgcggtgtaccgggccgccaaactgctcggctaccggcccaacctcgccgcccgcaacctcgcgcgcggcaagagcggcgtggtgctctacgtggtcccgcacgtggccgtgggcgagatgccgatgcaggccggcagtcgcatgaccaccgccctggcccgcgagggtctgctgcaggtgcaggttttcgagaccgacgacgaccagcacgtggtcgacgccatcgccaacctggaccccgtcgcggtcaccagcctgttccccctgagcgccgcggcccgccgggcggtgaccgaagccggcatcccgcacatcgagatcggcaccctgcccgcgctcaacgacccgcacctgtcggtcggcgagatgcggattgcgcacctcgtcgagcgagggcatcgacgaatcgcgttcgcctacaccgggattgcccgttggcggccgctgggcgactactggttcgaaggcgtatcgcgggcggcgcggttgcgcggcctgccgccggtgcgcgccgacgaggtcaccctggacaccgccgcgtcggtggtcagcgcctgggtgcgcgacggggtgaccgccgtgtgcgcccaaagcgacgagatcgcctgcctcgtcctgtacggcatccatcgggcggggctgcgctgcccgggcgacctggcggtgatgggcgtcgacgccagcccgatgggcatggtcagcacgccgccgttgaccaccgtgcaattcgatccctgcgcggtggccgacgcggcgctggcggcggtcttcgagcggctggggcatgccgccccgccctcgcccgagctgaccgacatcgcgcgtctggtggtgcgatcgtcgacctgaagctcagtccgcgggctggtagcgcagcagcgtgacgtcgtgctcggggtagtcgcaaaacaccggctgcacccgcatcccgacccgcagctgggccgggtcgacgttcaccatttcggtggaaaaccttgggccctcgtcccattcgacgatggccagcagctgcggcaccgcgtcggcgaagtgcgggctgaccggccggtgggccaccgtgtaggagtacagcgaccccatcccggagatctcccgccattccaggtcgtcggccagggtgcggggcgcgcgcacccgcgggtagaacacgtaggactgcagcgacggcgagtactggatgacgatccgatgctgcgccagcgcatcccaaaacggcgcggtggtgggcgttttgacgggcatcggccgctcgaaggtggtcattgcgatcagtctccctcgaggatgagtgtggtctgctcggacaggatccccccgttgccggacacgaaggcccggttgcagtcggggacctgcgccgcgccggcgcggcccatgatctggcgggtggcgtcgcagacgtggtgcatgccgccggccaaacccgcttggccgaaacccaattggccgccggcggtgttgagtgggaagtcgccgcggaaggtgaggtcatggtcggcgacgaactccatgcccctgcccttctcgcagaagccggcgtcttccagcgacagcagcaccgtgatggtgtagcagtcgtagatcgacaccatgtccatctgggcacggctcaggccggtcatggcgaacgcggtgtcggcggccgcggcgatcggggtgcgcagcaggtcctcggcgtaggtcggggtcttgaacggcacgtgttcgccgaatcccttgacccacaccgggcgatgacgcgcccgcttggccaggtccgcgttggcgaccacgacggcggccccgccgacacagggcatgacgatctcgagcatgtgcagcgggtcggcgatgaccgggctggccagcacgtcctcgacggtcagcggcgtgtcccgccagatcgccccgtcggtgtggttggcgttgacccgctggtcgacgacgatcttggccatcgcccgctcgtcgtagccgtagaccgcggcgtagcgctgggccacctggccgtacgggccgttctggccgaggttaccgtacgggatctcgaattcggcttgcggagaaccgtattggttgctcgacgagccgaagaacatcgcatcgaccatcggccggggtttcttcttcgacgacggcgtgatgtagcgggcgggcagtgcgcacagcacggcgtcgcagatgccgagctcgatcgcggcggccgcgcgccacaccatggccgcggcgctggccccgcccaggacgacgtgctcggcgaatcgtgcgcccacgcccaggtattcggcgatggtggagggcacgaagatctcggactcggccaggtgcgaggcgacgatcccattgaccacctcgccgggcagcccggcgtcctgcagtgccgccgcgcccggctcggcccactgctccagcacgaacggcgccggcgaggccttgctgagccgctccggcggcagctccacatatccgacgatcgcggcttccccgcgtaatcccatgtgcgcaacctactttcggggtagtccgaggatcatctgcgcgatgatgttgagctggatctcgcgggtgcccccgccgatcagttcggcgggcagatgcagatacggctcgacgacggcggggtcggagtcggcggccatcgccagtcgcccggtcagctgcagcgtggcctcgaatgtccgtcgcagcagcacattcatcgccaccttggcgatgctggacgccggcccggacgcctggccgtcgagcagccggatggtctcgcgcactcccagcgccttgatcgcgtggtgtaggcgtccagcctgccgagctcgcgcagcgcatcatcgcggtccggccccggttgggccgccagccggcgcagtgcggccgcgcggtcgaacttgacgtaaccgctgatggccgagcgttcttcggccatggtggcgattgcgaggttccagcccccggtcggttcgcccagcagcatgtcgtcgggcacgaagacgtcggtgaggaacacctcgttgaaatgcgcgtcaccggtggcggttttgatcggctggacctcgatcccggcggagcgcatgtcgacgacgaaatagccgatgccgcggtgcttgccggcctgcgggtcggtgcgggccagcagggcgccgtagtcggctcggtgggcggccgacgtccagatcttgtggccgttgatggtccagccgccgtcgaccttggtggcccgggtggacagcgcggccaggtccgagccggcgccgggttcgctgaacagctggcaccacgcgatctcgccgcgcagcgtcggcggtatcagcttctcctgcaggtctttcggcgcggcgcggatcaccgagggcaggatccattcggcgatgcccagcgacggccgaaccagcgcgggccgcttggcgaactcgtcgtcgatgatgagctggcgcagcgggccggcgtccagaccccagggcttgggccagtgcggcgcgatcaggccggcatcggagatcaacgtgcgctgcggccccgtctcgaattccgagtagtcgccctggcggccgggctggtcgttgcgcaattccaatgcggcatcgagggtttcggctaccttggcgcgaagctccgattccgcgtcgcccaggttgaccgccatgtcgcgctgccgggtgcaggtcagctcgccgagccggcgggcccagcggttggccggcccgatcgaggcggccaggctgatggcgcgccgccagtacagatgcaggtcgtgttcccaggtgaagccgatggcgccgaacatcgtcaacgcgtcgagcaccaggtccggggcgggcgagatcgccatcaccgccgcgccggcggcggccatgcggtgctgctcgagcgattcgtcgccggcgcggaccgcgtcccaggccgccgcggtggccagctcgctgctgaccaacagcatcgccgcgctgtgctgcagggcctggaaggttccgatcaccttgccgaactgctcgcggatccgcaggtgggcggtgacggcctgcacgcaccactggatcaccccggcggtcgtggcggcgaccagcccgaggaccacgcagcgggcgcgctcggggtcgatgccggtgagcacctcggagtccaggacgcggtggttgtccagccgcagcaccccggcgtcggcgacgaggtcggtcccggaaatgggttcgactgtcgccgttggcttttcggtgtccaccgccgcccacaccagctcgccgtcccgggtccgcgcgccgaccaggacgatgcgcgccgcgcacacccccgcggtgacctccgaggcgccgctgagcagccagtgcccgtcgccggccccggcatgcaggtcaccgtcgccgggcagcacgacggccgcggggatgccggcggcgaggtcgcgcagcaccgaccgcgcggccggtgccgggtcggccagcagcgcgaccgcgcctgcggccaccgtcggcagcagcggaccgggcaacagcgacttgcccgccgactccagcacgcaggcggcgtccatcagccggccgccctgaccgcccagctcctcgggcaggtgcacggcgtgaaaaccattggcgaccaagccgtcccaccatcgcggcagccggcccgcggcgagctcggcgaagctgtcccgggtggcggcgatgggagcgttgcgggcggcgaactgcccgacggcgtcgccgagctcctgctgctccggactcaaccccagggtcatgaggacggccgcactgtcactggcgatggccgcaccgaccgattcctctcgactccgctggcggcgacccgccgcgcctttcgcaagacggaccgtctcgtcttgtggcagactaccggggcgggtcaggatatgtaaagcgcgcccgatccccggcgagcgggcgccgactgcggatccgcagaagcgaggaccaccagatgccaaccgatcccaacgggcccgccgcgccgcgaagacgcagcgagaagtcgcgcaccgcgatcgtcaccgcgacccgggaactgctgctggagcgggggttcgacgggctgaccatcgaggcggtcgccgcccgcgccggggtgggcaagcagaccatctaccgctggtggcccacccgtcccgccctggtcgccgacgtgatgctggaagacgccgacaggctgctcgcgtccgtcgagcacagcggcgatctggccgccgacctggtcggctgggtgggcaagctggtcaccagcctcacgacgccgcgcggttcggccatgctgcgcaccctgaccgtggcgtgcatggagcacgaggacaccgcggtcaaactgcgcgccgggttcagcgcgccgctgcacgacagcgtgcgggcccgattgctggccgagggcgtggatgcggccaccgccgaatcggccgcggacgccatcgtcggtggtgtggtgtatccgattctgtccggcgcgcaacgctattcgcgtcgccgggcggaacacaccacccggctcatcgtggccgccctgaccgcagggtgacgcccggacggcattggcggcgcggcggattcgccgatccggcgtgcgccgcaaccgaatggtcctagcatgaggcggtggtccacacccccggttcgcccgatcaggccgctcccaaggcgcgcgacgcgtggcaattcttccagcggatgctcgccgacgtcaccgcgatcgtgaccgaggacgccgagaccgaacgggaactggccgaggggctgcgcgtggtggcgcgggtgtcgtcactgtgtgcgcagatgacggtcgaggccgacccggagcggccgtcgttcttcgatatgtgttcggacaaccggatggtcggcggccccaacccggacggcaactactacctggcgatgatccgcggggaccgccgctaccggatcaccggcacccggggaaccagcgcgtacctgggttttcagatcctggccggcaccgggctcaccccgcggcggatggccggttatctcagcgacgccgacttggcctcggaggcagggcaattcgcgctgctgctgtcggccgacgagccgtcggatccggccggcgcccagtgggtgaagatcccgccggatgcgtcgtcggtggtggtccgggaatacatcggcgatcgggccgccgagcaattggccgccctgcgcatcgaggcgctggaccccggcccgctgacgccgctcaccgacgagcagctcgccgatcagttcaccgcgatggcatggtcgttgatgaagctcgcgacgctgcacctcaccatcaaacccgaactgctgcaatcccccaacacgttgctgaccgcccaggccgccgacctgggcgaggccgacaccaccccggacaacctgtacatgatgggcaccttccggctcgaccccggccaggccctggtgctcgacatcgcgccgcccgacacccggtattggaacgtcacgctggaaagcatctggcacgaatgcctggagccgcgccgccggcacagctcggtgacgaaccgcggcgtgcggccggacgcggacggacgggtgcgcatcgcgatctccgcgcgggacttcgggtttggccattggctggacaccggcggccggcatcgcggcttcgtcgtgctgcgctggctggacaacccgagcccgcccgaggtcgcggtgtcggtgcgcgaagcgcgggagcgaccgtgagcctgcaggaccggttcgccccggaacggctgatcgccgccgcctgcgaggaggccggcagcgacgacttcggcgccgagggctggcggcccgggctacaccgcctcaccgacgggctgatcaacgacgcgcggctgtccgacatcggcgtcgagatcgctcacctggacatcatgcgcgcgctgaagaaccggctcaacgtaatcgcttggcgcaaagcacatcccgaggtggccgagcagaagatcagcgccccgatcttcatcgtcggccagccgcgcaccgggacgacgatcctctacgacctgctcgcccaggatcccgcgctgcgcgcgccgctcacctgggaggtcgacgagccctgtccggtgccgcggcccgagacctatcacgacgatccgcgcatcgcccggacacaggccggcatcgacctgtccgagcagatcatgcccgggttcctggcctttcacccgatgggcgcgctggtcgggcaggagtgtgtgcgcatcaccgcggccgagttcgtcagcatgatcttctcggtgcagtaccggctgccgaactactaccgctggctgctgtacgaggcggaccacgcgggcgcctaccgcttccaccgaattttcctgcagcacttgcagtccggcgtgcccgggcagtggttgctgaaatccccggcgcacctgtggcagctggatgcgctgctggccgagtacccggacgcgctgatcgtgcagacccaccgcgatccgctcaacgtcatctcctccatcgcggcgctgacccatcacctgcgcgggatgtgtagcgacgagtccagcatcaccgagtgcgcggcgcagtcctacgaggagatcgtcgtgggcctggaccgcgagatggccctgcgcgaccgtggcgccgtgccgcccggccgcgtgatcgacgtgcagtacgccgatttcatgaaggacccgtggaccacgatcaaagacatctatgagcggctggaccgcgagctgcggcccgatgccgagcaaagaatgcgcgagttcctcgcgtcgcatccctccgacggtgggcgcagccgctacacctggtcggacaccgggctggacgccggtgcggtgcgtgagcgggtgcgcacctatcaggaccgctacggggtacccaccgaggcgttgcgctgaggcgacgggagctgcggtggacgacgattgcctgaaactcaccacctacctggccgagcggagacgggccgggaaccgcttcgtctccgacgtcctgctagacctgtacgcccgccaccgggtggagtgcgcggtgctgctccgcggcatcggcgggttcggcaccggacaccggctgcgcagcgacgagtccctcaccctgtcggaggatcccccggtagccatcgtcgcgaccgacaccaggaccaagatcgaggcgctgctcgatgaggtgctggccgtcaaacaacgcggcctggtcaccttggagcgggcccggctgctgcacgccgacgtcggcgcggcgcggccgcccgagggtgacgccgtcaagttgaccgtctacctcggccgcaagcagcgcgtcaacgggacgccggcctacatcggggtctgcgatctgctgcaccgacgcggcctggccggcgccacggtgctgctgggcgtcgacggtgtcgtgcacggagaacgccgccgcgccagcttcttcggccgcaacgtcgacgtgccgatgatgatcgtggtagtcggatccggcgcgcacatcgggcgggtgctgcccgagatcgccgcgctgctgcgccggccgctgttcacgctggaacgggtccgggtatgcaagcgcgacggccaattgctggagccgccgcacgccctgcccggcgtcgacgagcgcgggctgccgctgttccagcagctgaccgtgtacacctccgaatccgcgcggcacggcggcgtgccgattcaccgcgcgatcgtggcgcggctgcgtcaggcgacggcggccgacggcgccaccgtgctgcgcggcgtctggggttttcacggcgaccacccgccgcacggggacgggttgttcgcgctgacccgacgggtgcccgtggtcaccatcgtcatcgacacgccggcccacatcgccgaatccttcgccgtcatcgacgaattgaccggcgccgagggcctggtcaccagcgagatggtgcccgcgctggtgtccgacgacggcggacccggcgccgggcggatggcccggcaccgctactaactcagccggcgaccgaggcgtcgtaaatcgactggatcgccttgtccagcgtcgcgttgaactgctcgtcggactggtcgaccgtgaggccctcggtgagcgcccggctgaagctggcgatcaggccggcgttcttggccagcagctcgttggcctcctcgcgggagtagccacccgagagcgccaccacccgcatcaccttggggtgttcgatcagcgggcggtagaagttggcctcggtgggcaggctcagcttgagcatcacccgctgcccgtcgggcaccgagtcgagttgcttggtgatctcgtcgcgcaggatgccctcggccttggccttgtcggcgatcgagatggtgacctcgggttcgatgatcggcaccagcccgtgggagagcacctggtgggcgagctcgaactgctgggcgaccaccgcggcgatgcccaccgggttggcgccgccgatcaccgaccgttccttggtgccgaacacgcccttgctcacggcccgctgcagcagctcgtcgagcccggggatcggcttcatcagctgcacgtcgtcggacgcttcggccagacccttgtcgatcttgaggatgggcaccacgcccttggtctcccacaggtaggtggtcgacggcttgccctcgatgtcgcggtccatggtctgctcgaacaggatcgccgccagcacccggtcgccggtgaacgccggcgaggtgatgatccgcgaccgcatctggtggatgaggtcgaacatctccttctcggaggagtacgcgctgtcttcgatgccgtacaggcgcagcgccttgggcgtcgagccgccgctctggtcgagcgcggcgatgaaccctttgcccgatgtcatccgctccgcttgctgttggttcgacattgaactctcccacttcctcatggccctcacgggcacaccgcacatggtccgcgccggcgcggcgcacccggcctccgacttttgagatgcccgcgcgcgctcgagcttggatcgtgccgatcatattcgccgcgtcccggacgagcgtgcgggagggtaccgccgccgcgggtccggtaaacgtcggcgccggcggccggcggacccggcatcgggcgacggcgcccgcaaaccgtccggcattttgggcgtgctacgccgcgtgtcctaccattgactaaacgcgtgttagctggatctgcactcgcagcgcagatcgacggggtgcgtctcccccgcaggcgagcgagttcccgtggggttgaatcaacagcccccggatatggcagtggctgttttcgatagctagccgtgtcccccgcagggaccgaatgtgagtgatggaccatgggcgaacaacccggcgatctcgccgaccccacccccttcgaggtgggcaaacaccaggtagatcaggcggtcgtgctcaccgtctccggcgaggtggacatgctcagctcgccgatgctggccgaggccattcagaccgccctggccgccaaaccggccgcgctgatcgtcgacctgtccaaggtcgggtttctggcgtcggccgggatgaccgtgctggtgaccacgcaggccgagctgcagccaccgacgaagttcgcggtggtggccgacggctcggccaccagccggccgatcaaactgatgggaatcgacagcgtgctctcgctctacccgagcctgaacgacgcgctgagcgccctgtccggtgcgtgagccgcgccggggctgatcgatgaccggtcccggttcgcgcggacgcgaatgcctgatcactgggcgcgggccagcacctgctggatgcgttcctgccgcggcagcaccgggccgtcgtcgaggggttcgtcgatgcccagctcggcgagtccggccttggtcagcagcccggtgccgtaggcggccagcaccagcttctggtcgtcgctgtggccgtcctcgacgagcatcgccccgatgaggcagatgaccgccatcttgtaggcgttgaaggcccgataccagggccggttgaccggctcgatgccgctggccgactggtagtgcgccagcagggcgtcgatgggcagcgccgcgggatggctgttgatcccgaccggctgcatccacagcatctccagccagccgatgtcggtgagcgggtcgccgacggtggtcatctcccaatcgaagaccgcgctgacctcgccgccggtgaaggcgaagttgcccggtttggcgtcgccgtgcaccagcgtgatgcgcgggcacggcgcaggcttaccggcaagcagcgcccggtgcagccgctccagggcgggcagcggcccgcgtttgacccggttcatctcggcggcccagtggccgagttcgcgatccaggtggccggcgccgtcgtcgagggtggccagtccggtccgggtgaggtcgacggcgtggatcgcggccagctgttcggccaggctctcgcacatccgggccacggtgtcatcggacgcatcggcgggcggctgcatctcgtagacctcgccggcgacccgttccatcacgaagaacggccggccgagcacgtctccggtgggttccagccacagcgcccgcggcgcccggacgtcggtgtcggccagggcgcgcaggatgccgaactgtcgcgccaggtcgtagggctccagcagcgccggcgggctgggccgcagccgcaacacgacgtcgcgccgctcgtcgcggccgcgccgggccgcgatgacgctcatcgtcatcatctcggccgagtgcccgaagctgacccggtcgatgccctcgacccgcacgtcgtcggcgtccggcagccggccgcgcagccagccggtcagccgtcgttcccgctcggtgcccagcgtcaccggtcggccccgtcgccgtcggccggcaaccggtccaccggcgtcttgtcctgggtgaacgcggacatgtccatggccctccaattggggtagcgacgatagccctgcccgccgagcagcaattcgaagatgccccaaccggtgtggccgtcgcgttcgaaccgcatcagctggtcgagcgccatcgatttgtcctcggtctcgctcagctgctcgggatcgctgctgtcccaagcgaaatggatgaagtaggcgccgccgcccaggtcttcgtagtggcagtgcgccatcggcagcccgtagtaggcgttgacctgcggatggggcgcctcggcgaccacccggtgcgcccggccgtcttcgtcggtgaacacgagcaccgcgcgcacgggccgcttgcgctcgccgtcgaattccacctcgtgctggatcttgacgaaccgtttggacagcgtcccgtcggcataggtgatgccgccgtcgacgtaaaggactgtgccgtcgcaggattcgatgacccacgcttcgacggcgtggtcgccgaacccggcgtccagccacagccagaagtcgatccggtcggagacccgcaccccgaaggtgcggtcccggccgccgttgaagccgtcgacgctgacgcgctggccgtcgatgcgcacccagccgctccagcgccccggttctttcatgtggtacatgtcggccagcagccggccgtccgggccggacaccttcatcggcaacagctcccacatcggggcggtgggctcgtagtagagctcccattcgatgccggagttgttgggcccgacgtcgagtcgccacttcttcagcggctcgacgcaggtccagcgcatcggcccggcgcgcagctcacccctgtcgtcgccggtgaccggccgccccgacagcaggtcccagtgccggccgtcggcgaggctgaccttgacgtagcccagcccgctggcggtgttggggttgttgccgtagccgctggccagcagcatggtgccgtccggtgccgcggcaaagaaataacagcgatccgaccaggtcgggtcggcgtcgtgcacctggtcgaaggtggtcggaagctggtgggtgaacgactcgtcggcggcggaataccccatcaatcgccctttctggctggcaatatggttgcgcggcaaggtatttcgtcaacaggtccggccctgtccgcgctgctgcggatccgatagccaagccgcacaacgcatcccgtaacatcgccgccatggaaccgagccggcggtggggcgacgaccgcgcgatcctcgacgacgaggaggcccgcagacggatcctggaggccgccggccgctgcatcgtgcggcggggcaacacccagttccggatgggcgaggtcgccgacgaggcgggcgtgtcacggtcgacggtctaccgctacttccccggccgcgacgacgtgctgctgggcctgatgctgcgccgagtggaccacgccctcgcggagtcggtgcgctcgctgcccgcccccgaggaccccgttcgctcggtgccgcggatggtgctggcgcgggtggaatcggtggacggcaacccgctgaacgaagcgttgttcgccgccgagagcacggcgatggccagcgcgctgcagaagggctccgaaccactggtcgagctgctgttgcggcattacggcccgctgctggagcgctggaaggcggcggggctgctctacccggacgtcgatttccggtccgtcgtgcagtggttgcacaccgcgacgctgttcctgctggcgccctcctggcgatatcggccgcacgccgacaagcgccggttcgtcgagcagttcgtggtgcgggccttggtgccacagatcagacaataatcgtatattgtctgatgtccagacgttcgagtggttctcctcccggacgccggtgttcagcacgcagcaccgcaaccggtcggcgaaccaggatggttggacatgaaaaaccctgtgggacacgctttctcattcctgggcctggcggctcacctgggtcgcggcgcgggccgggtgtccgtcgacgcggtgctgggcggccggttcggcctgccgcgcacggtcgacgagatcgacccggcggtgctgtcccgggtgatgggcaccacggtgcggacggtgcgggtgctcagccgcgacgccgggacgtcctcgcgggcccggctggtgctgaccggcaaggacgtccccgactcggtgttcgtcaaggtcgcggcccagaccgccgccacccgcctgatgggtgagctcggccggctcggctgcaccgaggtgcggttctaccgccagctggcgccgcaggtggtcggcgtcccctactgctacggcgccgcgttcgacgcctggacgggccgctacctgctggtgctggaggatctgccggccgaggcgtgcgagttcccagacaccttgcacccgctgtccgccgaccaggccggcctcgtcgtcgagctgctggccgacctgcacgccaccttctggaaccggttgccccgcgacggccgcggcccgctgggctggctctacacgccgtccggcgacgtcacctcccttctgaccgggtcgctgatgcacagctcgatcaagcggctggccgagcgcaccagcatcccggtgcgcgacggcgtcttcatcgccgacaactaccgcgccgtcgccgccctcatcgacgccgccccgcacaccgtgatgcacggcgacgcccatccgggcaacatgtacttccacggcggcaaggccgggctgctggactggcaggcggtgcggcgcgggcatccgtcccgggagctggcctacacgctgatcaccagcctgacgccggaggatcgccgggccacccagcgcgacctgctcgacgactaccgccgcgcgctggccgcggccggcggcccgcagctggaccgcgacgagctgtggctgcggtttcgccaggccgcgctgtacgcctacgccgccccgctgatcaccgccggcatgggcggcatgcaggtcgaggacatcgccatggaagggctgcggcgcggcgtcgccgcgctcgaggacctggaaaccgtcgccgccctgaagagttcgctctagctctggcggccccgcccggcggcaccgaaattccgccgaagctattgccttcgccgcgccacgagttacgctacctaccgtagcgaaatatggcgcgtgcggcgctcagccctccgagacggcccgcggcggcgaagaggagtctcatgttcgacctgaaaatcaccggcggaaccgtcgtcgacgggacgggcgcgcaacgctatcgcgccgacgtcggcatcagggacggcaagatcgtcgacgtcgtccgcgccgacggctccgaggccggcggcctggcgaccgccgaggccgccgaaaccatcgatgccacagggaaaatcgtggctcccggcttcgtcgacatccacacccactacgacggccaggtgagctgggacagtctgctcgagccgtccagcggtcacggcgtcaccaccgtggtcaccggcaactgcggggtcggcttcgccccggtgcggccgggcaccgagcagtggctgatcgagctgatggagggtgtcgaggacattcccggcaccgcgttgaccgagggcatcacctgggggtgggagacctaccccgaatacctcgacgcgatcggcaagcagaagttcgccatcgacgtcggcagccaggtcgcgcacggcgcgatccgggcctacgcgatgggcgagcgcggcgcccgcaacgagccggccacccccgacgacatcgaggcgatgggccggctggtccgcgaggcgatcgaggccggcgcgctcggcttctccacgtcgcgcacgatgggccaccgcgcgatggacggcgagcccgtgcccggcacgttcgccgccgaggaggagctgttcggtctgggccgcgccatggcggccggcggtcaggcggtgttcgagctggccccgcagggggccgcgggcgaggacatcatcgggcccaagaaggagctggactggatgcgccggctcagcggcgagatcaaccggccggtgtcgttcgcgctgatccaggtggacgccgacccgaacctgtggcgcgagatgctggacctgtccgccgatgcgcacgcggccggcgcccgcctgtacccgcagatcgcggcgcgcccgttcggcatgatgatcgggttccagggccatcacggtttcagccaccggcccacctaccgccggctggccgccgagtgcagccgcgaggagctcgcgcaacgcctcgccgaccccgcggtcaaggccgcgatcctcgccgaggacgacctgcccgtcgacccgaccctgctgttcgacgggatgttcgcgctggtgcagcactcgctgcaccgcctgtacgcgctgggcgacccgcccgactacgagcccaccccggaccgcaccgtcgcggccatcgccgaggcgcgcggcgaggacccgctggcgaccctgtacgacctgatgctcgaggccgacgcgaccaacatgctgatgctgccgctgttcaactacgccgacggcaactgcgacgccatccgcgagatgctgctgcatcccgccggggtgctggggctctccgacggcggcgcgcactgcggcatgatctgcgacgcctcctacccgacgttcctgctcacccactgggcgcgcgaccgcagccgcggcgacaagctggcgttggagtacgtgatccgcaagcagtcccgcgacaccgcccacctgttcgggctcaccgaccgcggcacgatcgagcccggcaagaaggccgacatcaacgtcatcgacatggacgcgctgcgcctgcaccccgcggcgatggccttcgacctgccggccggcggcaaccggatcctgcagggcgccagcggttatgcggcgaccatcgtcagcgggaccgtgacccgccgcaacgacgtcgacaccggggcccggcccggccgcctggtccgcggggcgcgctgaggggcgccgcggcgatggctgcggcggccggcaatccggcgcgcacccgcgacgaggatgccatcggcaccccgccgccgggcccgaccctggtgcccgccgaacgctactactcccccgccttcgccgcgctcgaggtggagcggatgtggccgcgggtgtggcaactggcatgcatggtcgatcacgtcgcggcccccggcgactacttcgaataccgttgcgggccatacggtgtgctgatcgtccgcggcgacgacggcgcgctgcgggcgttccagaacgtgtgccggcaccgcggcaactcgttgtgcagcggctcgggttcgggcctgcgggagctcaaatgcggctatcacggctggacctgggacctggccggcgcgctcaaacgggtgcccgaccgcaagggcttcggcacgctgcggctgtccgactatccgctgatcccggcccgggtcgacacctgggcgggcctggtcttcgtcaacctggaccccgacgcgatgccgctgcccgaatacctcgaggcgatacccgaggacaccgcctggtgccggctcgacgaattccgttgctacgccacgctcactgtcgaggtcgacgccaactggaagaccgtcgccgacggctacagcgagacctaccacatccagacgctgcatcccgagctgctgcgctgcgtggacgatatccatgcgccgcaacagatctggggtcacaccgggaagtccgatcagccctacggcgtgccgagcccacgtttcgagggtgcgctgagcgacgaagaggtctgggacgcctacgtttccacccagggcgcgctgatgggtgcggccgagggcacgccgtttcccgccgccgaccaccggcccgggcagacggtggccgacctgatcgcggaccgcacccgggcattcgccgcgagccgcggcgtcgatttgggctgggccgacaccgaccggatcacccggctgcaccagtacaacgtctttcccaacatgacgtttctgaccaacgccgaccacctcaccgtcatgtgctcgcggcccgcgcccgacccggccgccgcgcccgacaagggcgagctggtgatgttcctgaccacccggatgccgccgggcgcgccgcgcaccaagccgaccgatgtccggatgagcgccggggaagccgagcccgggctggtgctcacccaggacatcgcggtgctcgccggcctgcagcgcggcatgcaccagcccggcttcacgcatctggtgctgtccagcgaggagcggcgggtgatcaacatgcaccgcaacctggaacgctacctggacctacccgccgcacagcggatgagcggcggtgccgggacgtgaccgccggccgcagaatccgtgtacacaacgccaaagcgggccccggcgatttagaatcccgcttgtgatgaccccgtcttacccctggggggacgatcgagggcaactggcgcagcaactacggctgcggtatcacacgctccgccggcggcgcgcgcgacgactgtgccacagtttcgaacgggtgggtgttcggacggcgccggagcggctgcgggaaatgctggcgggcgcgccgctggccgctcatgaagtgatcaacgtgaatttcgcgttgatcgcgatccagctgaaccgggaggcccgggtcgcccggtaccggcggctcaggcagcgcggagcccgctcgctgatgttcgccgggctgatcatggtggtgatcaacttcctgatgtgcatggcctacctgctgctcaatctcgcggagccggcggcgcccctgtaggcccccggtggctcgtcagcgcggggcgacgatgccgttgtcgtaggcgtagacgatcgcggcggcccggtcgcgcagatcgagtttgccgaagatccggccgatgtggcttttcacggtgaccccggagatgcacagctcgtcggcgatctcgctgttggacaagccttttccgatcaacgtcaacacgtcccgctcgcgggtggtcagttcggcgatcgcggcgccgcgggggccgggcgcggccttgcggtaagtggtgagcacccgcgaggtcaccgcggggtcgaggtagccctcgccccgggcgaccgcccgcaccgcgcggatcagttcctcggcggacgagtctttgagcacgaagcccgccgcgccggcgcgcagcgccccggacaacagctcgtcctcgttgaaggtggtcagcgcgagcaccggcggtctgccgcccagccggcgggtcgcctcgatgccgtcgacgcggcgcatccgcaggtccatcacgacgacgtcgggccggtgcgcggcgatcgcggcgggcacctcgtcgccgtcggcgcactcggcgacgatgacgaatccgtccttgcggcgcaggatccggcgcagcccggaacgcaccaagtcctggtcgtcgacgagcagcacggcgatctcgggggccgggtcggtcacgccttaccacaccaccacggtcgccaggagccgtcgctttcctgcagcgggatctcggcgcacaccgaccacccgtcccgggtggggccgacgtcgatggcgccgccgagcagctcgacgcgctggcgcatgccgcgcacgccgcgcccctccggcgaccgcgcggccaccaccgccgccggcagtatgttggtgaccgccagccgcgccgacgccggggaaatatcaagcaccacaccggctttcgactcgggcgcatgcttggcgatgttggccagcgactcctgcgtgatgcggtacagcgccagccccaccgccggcgagacgtgatcggtgggtccctcgacgcacagcgtgacggccaggccggcgcggcggaagccgtcgaccagggacgcgacgtcgtcgaggccgggttcgggggtggtcggcgcggctttggtgggccagttgtccagcagcccgacagtgcggcggatgtcggccatcgcctggcggcccagccgttcggcctgctcgagcgcctccaccgcgtcgtcgacgtcgcgatcctgccgcaacgcccgccgcgcccccgtcacgtgcaacagcgtgatgctcagcgaatgcgcgatgacgtcgtgcacctcgcgggcgatgcgccgccgctcgtcggcggcggcgtgctcggccagcatctgctgcgcctcgatctgttcggccaccagcaaccgttgggtgcgcatcaagtagcccagcagccaggccgccacgatgaaccccaggtacaacacgatcgcgtcgaggcggtgcagcgcggccgcggtgagcaacagcgcggccgccgacgcggcggccagcaggccgcccaccaccgaggccagcgtcgcgacgacgaggaccatcaggaccaacagggccggcgcgaaatcggcgcgaatgggcgtggacgtgccgaacagcgtcagcgcggtcgacgccgtccaggtcgcccacaacggccccggggtcattttcatgttgaagacgaagaacgccaccgtgggcgacagcgcgatggcgaacgcggtcagcgacacgggcaggtcggcggcgggccgctgcagcgtcccgatggtgccgccgagcagcagggccgcatcgacggcgatcagcgacgcccacgtaagaccgacgggaatcagctcgccgcggcggcgaagctgttcgcgcaggtgacatattgcggcgcgcaacatcgtccaatcctagaagagccccgccggccgcgacatcatcccgcggtcggcacccggctccgcccgtggtaggaggcaaagactgcacttcggcacgacgcgcgagggcttgcactttcctagcgtcgagtcatgacatgggcactgctgcacgaccggatggccttcatggccgaagtgatcaagaccgccgagaccgacccgtccgcggcgctcgcgttgatcgacaactcccccagggtgcccgagctgttcggcgacgcagagggattgatgttgtcgctcggccagcgctggatcaccacgctggtggccaagctcgaccaggcggcccacgagggcacgtcggccgaacaggtgcgggccgatctcgaggccgcctcgcccgggctgcacgcgctggtgaccatcggcgcgcgtcgctcgctgcggatgcggtcgatggcgcgcggtgagcacgtcgccgtcagcctgttcggcgggccctcgggcgatcggcagaccgttgcctgaccggccgggcatcctcgggcggctgaccggccggtacgcgctgctggtggtggggctgtgggtgctggccgcggccgtcgccaatgtggctgtgccgcaactggaacgggtggtcgacagccacgcccggtccttcatgccgccgagcgccccgagcgcggtggccgccgcccgggccgcccagttgttcgaccagacgccgagcaacaacttcgtttacgttgtgctggaacgcaatcagcggctgggcgccggcgatcggcagttctacgacgcgttgacggcggcgctgggctccgaccaccggcacgtgtacgcggtgaccgacctgtggtcacagcccgccaccgcggccggcgcccagagcaccgacggccaggccgtcagcgtgatggtccggctggccggcatgctcggcaccgcccaggcccgtgattcggtgaacgcggtgcgcgccaccgcccagaagctcggcccgccggccggcctgcaggtccatgtcacgggccccggcgccaccatcgtcgacaaattctccgcgatcgaccggcagatgctggggatcaccgccgccaccatcggcctgatcctgctgttgctgctggtggtgtaccggtcgccggtcgccgcggcgatcccgctgatctcggtggggctcgccttcgcgctggcccgcgccgtcgtcgccgccctcgggcaggccaatgtaattgaggtgtcgctgttttcggttgcgctgatggccgccatgacactgggcgccggcaccgattacgcgatcttcctggtgggccgctaccacgaagcgcggcgcggcggcgtcgcgccggcccaggcgctgaccgtggcctaccgttccatcgcgcccgtggtgatcgggtcggcgctgaccgtgtcggtggcattggcctgcctggttttcgcccacgtgggatcgttccgaagcgccggattaccttgcgccatcggcattctggccaccatggtggcggcgctgacgttgacgcccgcgctgatgagcctggcggtgcggcgcggatacctggaaccgcggccgtcgcgcaccgcgcggcgctggcgccgggtgggcaccaccgtggcgcgctggcccggtccgatcctggtcgccgcgttggggttgaccctgctggtcgccctgccgctggccggcatgcggatcggcttcaacgagcccgccgccacgccgtcgtccaccgactccaaccgcggatacgcaagcgccggccggcatttcccggagaacgcgttgctgcccgacgtcatcgccattcgggccgaccacgacctgcgcaacccggcgggcttgatcgccatcgaacggatcacgcggcacatcatggccgttcccggcgtgcgtgccgtgcaatccgccagccgcccggacggcaaggtgcccgaacaggcgacgttgagctatcaggccggggtgctgggccgccagttcggcgacaccgtggattcgctgacccagcgcctggcgcgggtctccgagctggacggcgcgctggcgcagacccagcacgcggtggatggcctcggcaacggattgcgcggcggcagcgcgggtttggccgacatgtcgggcgcggccgacgacatgcgggccgggatggacggcctgcagcgcaacgtcaccacggtgtcgggctacctcgacccgctgcgcgacttcgtcgggcggacccccgactgcgccgccaacccgatctgctcgacggtggaccgggtgctggcgccggtcgacagcctggtgcagacgtcggcgcaactcggctccggagccgccaagctgaccaccggctccaacaccgccgccaccgcgatggccgggctgccgcagaacgtcgacgcgatgaaaagcgccctggtgcaggcgcgttcggcgacgcgcgatctgctgggactgtccgacacgctggggccgcagatgcaccagctgaccgactacctcaacgagatcagcacccagttccagggcagtgccgccgcggatttctacctgccgcagcgcgcgctcaccgatccgcgctacaccgccgtgctgaaccacctgatctcgcaaaacggccgcgccgcttacctgttggtgtacggcgacggcgcggagtggggcgccgacggtgccgggcgggccgagcaggtgcgcgcggccatcaaggaggccaccaaggaaggcaccctgacccccgtggaggtcgacctcgccggggtcggcccggtcaccgccgacctgcagcgcttcgtggccgacgacacccggctgctggtgggcgccgcgctggtgctgatcttcctgatcgtcaccgcgatgctgcgcagccccgtggcgggcctggtggtggtcgggaccgtcgtcacgtcatacgcctcggcgatcggtgccagcgtgctgatctggcagcacctgctgcatcaggagctgcactgggcggtcgccccgatcgcgttcatcgcgttgatcgccatcggcgcggactacaacctgctgctggcgttgcgcatcaaacaggaagcggcggcgggacttcggaccgggatcatccgcgccttcggcggcaccggcggggtggtcaccgtcgccggcatcatcttcgggctgaccatgctggcgctgctgaccagcagcgtgctcagcatcgcccagatcggcaccaccatcgccgtcgatctgctgctggacactctggtggtgcgggcgttcatcgtgccgtccatcgtggcgctgttgggccgctggttctggtggcccagtcccctgccccgccgcggcgtcgcccgcgtcgtgaaaacggttgagccgcaaccgctcagcgtcgctactgcggtgtgatgaccgtggacggcagcccgaccagcacgccctcgacgtcgccgtcggcgctgagcagcaggccacgtcccggcggcagcgcctgggcgcggacgttgcggttgatccggttctgcgggtcgttatccatatacagctgggcgactttcgcggagttctggaacctgatccacggatccatctgcagggtggcccagttcgcgctgttgcgggtggtgaacacgtgcaggccgatctggcgggcccgctccatcagcttccacaacgccgcgcccaccggcggcttgggggggtagctctgatcgggccgcaggtcgccgatgtcgtcgatgagcacgaaatgccgtgggccttcccacggtttgagggcgcgcagctcctcctggctcaggcccttgggcggcagccggggcagcaggatctgttgggccagtgcggtgatcacctcgtcgatctcgtcctggtcgtaggcgtaggcgcgcacataacccgggccgtgcagatcgcgcagcccgtgcggagcggtcttggggtcgatcagcgtcagctgcgcctcctcggggctgaaccggctcatgatcgcttccccgattgccaccagcgacaaggtctttccgcagccttggcgccccaggatcatcagcccggggctttcccggaggttgatgggcaccgggcccagctcgtgccgctcgccgatggcgaacgcgatcgacagatcgtccccgctcgggtgggcggcctggtactccaggatcgtcttgagttccacccgctgcggcagccgctgcagggtggcgtgcttggtgacgcccgcgacgtcggcgatgcgggcacccacgtcgacgatgctgaccatctggccggtcgcggggtcggtcagcgccggcacccccacccgcagctcgtgcaggctgtcggtcagcccgaatccgggccggttcagcgtgcgccgggccgcgtcgcgtgactccagcgacgagtgccccatctggctttcgctcggatcggccagccgcaattggattcgcgccgtggcgttttgcagcaggctctgccgctgcccgtggatccaaccgcccgcgctgcacatcacgtggaccccgtactcggggccgcggctactcaacgagatgatgcggtcacccagcacggtgtccttggagtacaggtcgtcgtagtcgtcgaccaccacgaacacatccccgaacgggtcgttggcgtcggtgccgcccagcccgtcactgcccggaccgaagcggcgctcccggaacccgtcgaggtcgatcttgagttgccggaacgaattctcgcgggcgtcgatcagcgcgtccatgctgctcaagatccgctcgatgccctcggcgtccttcggggacacgatgtcggtgacgtgcggcagcgaggcggcctgggccagcgtcgccccgccgatgcagaagaacgtcacccgcgccgggctgtacatcgttgcggccgagcacatcagcgtcatcagcgtggtggtcttgccgcgctgcttggcgccgaccacgatcacgttgctgcgcagcgcgtcgacggcgtggaccacctgcttggactcctcggggatgtccatgacaccgaccgggaacatcaggcccgggttctgcccatagtcgacgtgccagggcttgccccggtacccggcgaccaggacatcgatgggttcgggatcctccagcggctccagccagggccgccccggcgagcggtgcggcacgttctgcagcgactcgcgcagcacgtccacgatcttcttgcgcttgaaaccgtcttcgtagtaaaggaattcgtccggctcggcgtcgacggcggcggcctgctccagcgcggtcgcatcggcggcgtccagcggctggtactgccagttgtacagccgcggcttggtcaacgtcatgtcgacggtggcggcgacctccttggtcttgggaaccacgaacggcgcggacaggtagaagcaccggaacggctccaggtcgcgcggccccaccttcagcagaccgaagccgttctccttcgacggcaggtggtaggcggcgtccgagccgatcacctcgcggctgtcgtccccggattcggcgcgcagcgcgatgcggaatgcgatgttggacttgaccttttgcagcgaggacaggtccaggcgctggcctcccagcatgaagaagacgttggcgccgcggccctcctgaccgatgtggatgatgaggttgatccacttctcgtggttggcgaacagttccaggtactcgtcgacgatcaccagcaggaccggcaccgggggcagatcgcgcccggcgagccggatctcctcgtagtcgttggcatcacgtgcgcccaccgaggtgaacagctcgtaccgctgtttgatctcgccgtcgatgacccggcgcatccgctcggccaggtgccgttcgtccttgcccaggttggacagcgcggccacgacgtgcgggatgcccaggatgtcctgggccgctgactcgaacttcatgtcgacgaagatgacgttgaacgtctccggcgagtgcgtcagcgcgatgccgtagaccagggacaggaagaactccgacttgcccgagccgctggtgccgatcaccaccgagtggaaaccgaagccgccgaagtcttttgcccggatgatgatgttctgcagctcgccgttgggtttcgcccccaccgggacctcgcaccagcgttcgtcgccgcggccccgccgctcggcccacaaccggtccacgtccaactcccgggggtcgctgatgcccagcgcccgcagcagttcggtggcgccgctgaccgagtcgtcgatctcgctgcggctggtcggcgaccaccgcgccatcgcccgcgcgtaccggtaggcgcggtggatggacagctggtcggcgtgggcgaagaacttgttgcgcacccgcagcagcggggccgggcggccgtcctcgccgtcggcgtccgagccgttgcggcgcaacgcgatttcgccgttggtcgagccgttgggtgtgctgtgccgctcgctgagctcgaacacctggtccttggcgaagccgactccggtgcccacccgggatgcgatgcgcagcagcgtgattcccgccttgccgacctggccgaccacgctctcccaggcatcggggctgccggtgttgtcgtcgacgatcaccaggtgcgggccgagatccacggtgtcggtggcggtttccagcgccgagcccatggcggtggggctggccgccgccagcggtgtccagggaccgcgtttgcctttcatgtgcagctcggcgcccagggtggcctcgagttcctccggggtggcgaagaccagccgccgccacccgcaggcgtcgaacagctcgtcgtgcaggttgtgcggcagccacacgatccacgaccacacctcgggattgcgggtcaccaccagcagcttgacgtcgcgcgggttgtggaacaccgccagcgagcacagcaccgaacgcatcagcgaccgcagccggtccaggtcctcgccgacgaagctgaatccgggcgccgagcgcaggttcaccaccttggcgatgtcgcgaatcttgcgctgctccaagatgaaatcgcgcagggcctgcccggtgaccggctcgagctcctcgtcggaggcgacgtcgggccaggtcaccgacagcaccgagtccggcgcatgctggacgccggtgcccaggcgcacctccaggaagtcctcgtcgccccggccgcgttcccacatgcgcgggccgccgatgatggcgcccaggccgcgcgggtcggagtgaaccgagttctgccattcgcgttgcgcgcacacggcgctctggatttcgtcgcggttgctgtccaggtcccggagatagcggcggcggcccttttccatttcgccccaggtgatcttgcgggcccgcccgaagcgaccggagaacgcgagcatgctgaaggcgccgatgcccatcaacgggaagaaaccggtggacaggctgcgcacgccggagacgtacagcatgacgatggtgccgatcagcgcgacgatcagggccggcaccccgatcatcacccagatgttgcgcggttcacgttccggcagggcgatgggggcggcgggtgccacccgaaccggtttcggcggctcgatcttgacgcggttgatggggaacgctttcttggacattctctagcctcccggcttcgccgatgtggtcaccacagccaccttgcccaacgcgggcaccgtgtcgcgcgccaaaagcgctgcctcccttgacagcgcggggccggcggcgaaggttcgcagcagcggccagggcgcttgcaccgccgagcccggatcgagcccgagggcgcgcaatgtcgattcgtcgttggcgatcccgaaccggacgccgtagtcggacacccagaacagcgattcccgggaatcggaggtgaccacgccgctggtcgacgtcacgaagttcgccgcgcccggcagcaccagcacctggttggcgaccaaagaggccgggtcgcggtcgtcgcgcaccagatgcacgatccggttgtccagctacgacggcgtcggcagcccgcggccgttgtacacgacgacgcgcgcctgcggatccgtcgagcccttctcccacccgacgcaggtggtcggattggccgcggtgtcaatgaaattcagccgcttggtcgggtagtagtccaccgccaacgaggtcacctcgggaatgttgaccagcacgtcgggggtgaccacccgcggcgccgtcgatccgtaggagttggcgctgcgcagcaggtcggcgacgaagctggtcaccttttgcaccccgtcgggcagcaacacgtagaactgggtgccgccactggcggtctgggcttgcagcaccgcaccgacctgcgaacccgacacccacgtcgacggggtgcccgccagcggcaccgggggcacacccagcggctcggtcgcgggcagcgcgtcgaagagcgcccgcgaaatctccaccggcagcgtcactcccgggtccaggcccaggctcagcgtgaccgcgcggttgaccgggtcgatctgcgagcgcttgcctccccagatcacgtaggtgttgccctcgaacgtcaccagcaatccggcgtcgtcgcgcagcggtgtcgcgcggtcgaatccctcgagcggaccggcgatcgaggtcaccaccggcttttccgggctgcgcgggcggcccgccgtgtcgcacaccgcccaggctgaaatggcgccgcggtgcaccggcatcgccgccggcgccccggggatgccgaccagcgggcccgtcggatattttgctatctcagcgggtttcacccaggtcggctggttcgccgtcccggtggccagccgcgcggaggtcaggttcagcgccgggtagagccgcccgtcgatcttcgcgtagagcgccccggagtcacggtccccgatgatcgtcgaatcacccacgatgccagtgggtttcagcacgttcagcaacatcatccacccggaggcgatggccaccagcaccatggacagcaccagcgcggcggtctgcttgcggtcgtcgtgcttcatgcgcaccgagaagcgggtggtcgccgcccgcagccgccggttgtagaacaggtgcccggagttctggtcgcggttagacaaactcagcggcatcgtcagtaccccttgggtgatcggcgaggatcggcctgctgaatccgatcggcgagattcgacgcgtcggcggcaaccccgtaacggcccatcgcatagttgatgaacgcgcacgcctgcgcgaccaggttgtggatgtcgcgcgaggtgccgcgctggtgataggcggcgaaggtgggttcgatgaattgccaggcgcccttgctgggggtgccccgcgcggcgttggcatcccagtcgttgaccgcgccggcgttgtagttcgattcgcgacgggccaccaggtccatgccgcgctcccagcgggcccgcgccgccgggtcgtgaatgcccttgatatccaaggctttacggatggcggccagcaccgcggggcgtccgccgggctggttggtgggcccggcggccggacggcggcggcggtagtgcaggcgtcgcagccgcagcgcgagcagccgcgcgcgccgccgcgagcggctgatgtgccgatgctgggtgcgcagccgcgccgccatgcgggccatggcctcgcgccggcccagcggggtatcggcggccggtgccgcgtcggccagcgcggcgtccagcaccgtgcccgtcgccgcgcggccgtgcgcgtgatcggcccgcgccgccgccaacacggtccgcagcacccggtcggcgtcgtccgactgcgccagccgttgcgccaaggcacccgaccgggcgacaacggcggccggcagcgtggacggtgacgtggtgcggggccgggccgtcggggcaccgaggcggtcgcgggtaggggcgccggcgaacagttcgtggccgcgcgacaacgccgcgaccgcttgcattctcaggggatcggtcaccggcttccccaccccgatccacctgcgcgccgtggcggcgccgcatccttaccggacactcgagctagtactcccacaccctcctggccgcgaacgccgcagacctaccaatagcatgcacgtatcgacagttctgctgccaataacgggcaatccgggctgacccgcgcatgggaatcgttgggatcggccggccgcgattacgtagcgaccctactgcggtgggacccacccgaccactcacctctggtttcggggtggactattccttgggctcgtcgtcggacggcatgatcacgatccggcggttgggccggttggtgaccacggtcggcttggcctcgccgggcttgctgcccggagcgctgggcgggatcgtcaagcggcccttgaccggctggccgttgggcacgcccggggcggtgacccgcttctcgaccggcttgtccttgttgccgccttcgccgccggcgcccatcgcgcccggcggcatcatcggcatgcccgtcatgccggtttgtccgggcatggcgggcatcccgccggtcggcggcatcatcgcggctttggcgccggccggggtggtcggcggggatgacgtcggcaccggcggcgggcccagcgagctggtcggaaccgtgccgcccccgcccaagccggcgccgccgccacctgcgcccgcaccgccgcccaggccggatccggcgccgccgacgctgtcgaccagatgcgcgttgtcggccagcgacgccgcgccgtgggcgccctgaacggcgctcatcagcggctgcagggcgctttggcccgcctgcatcgcctgctggggaagctgggtgagcggtcccatgacgccgcccatcgccccgccgagcgcgccggtgacgctggacagcatctgctgcagcatctgcatctcttgcgagccgttggcctcgttggccgggaacttcgcggcggcgtcggcggcacgggccttgcggtccgcgtcggcggcggcggcgtcggcggcgtccttggggacgttggcgttgccggccccgccgaccatgccctgcccggcgtcggcgggtgacgtaccgcccggcggcaccggaaacggccgcggaatcgacgccggtggtcccccgactatcgccgtagtagtcggcagatcatttttgataattcccccgggaccacccacgacctcacctccaccccgctcgttcgacgcttatccaagcgctggcgatcattcgtatcgccattttgtcacagcgcgccgataacggtattcacccgaggaatgcgggctacgagccggcgcggtggttgattgcctggaaccaggccaggtgatagtgcgcgaggtactcgtggccgtcgatcaacgcctggatggccgccaaaagcatccagtctccgacggccgcagggtcgtgatggggatatgccgttaataccgcgtgttgaatttcggcggtgcattcgcgcagcatccggatttcgctttccagcacacccgtcttccgcaccgccggtgccgcgaccgcctgggcgatgcgcggcaggccgtcgcgacggcggacggcgtccaccagggtggggcccagctcgtctatctgcggtgcggccgaccgggccggccgatcgccgctgagtgtcggctcgtccgaacccggttcggccacataggtattggcgtgatgggcggccgcgaccgtgaccgcgccgagcaggtccaccacgttggcgtcgtggcggcgggcggccggctcgagcaaggttacgtgggcgggcagccggaggtgcggtggaatccacccgctcgctaggtcggtgacaagcgtggtggtgccgtcgtcgcgcagccccgccgcccaggacaggcggggttcctgccgggctaccgcgtcgacgagtcgctgcagccgctgctgttcggccgcccgactggatgcggcgccggcggtcgcgcccgcggtcgccgataccgccgatgcgttcgccagcgtcgaggagcccgcgccggcctggccggccgcggccgacgcggcgctgcgctccaccggggagaccagcgtgccgcccgccgatggcgacgatgccggcgagggggccaccggcgcgccggagaccgggccggtgggggcggacggcaccgatggcgccgccacgaccggtgggcgtagatcggaaccgtaggcgggcaaagatccggaggggaccgacggcccgccggtcgccgcggacgaccacgagccgcccgtcatgaccgccggtgcgaccggagcggcgccgcctgcggtcgacggggccggcgcggcggccggcggcgcgtcgacgggaggcgttgccgcgatgaaggcgccggcgctggggacggtcggcgctaccggcggtgtgcccgccggggtttgcggcgcccctgtctccatcgcttgcagcgcgttcgccggaaaggcttgtccgccaggccccgtcgcctggccggtcgccaatccagaggcgaacgattgcgccaggttgggctgcccgccctggccgaggcccagccccgacggcgccatcgccgcaggcgcgccgtgtacgcccgggacgccggacgggacagttcccgaggcggcggagaacgacggggcgccagcgggcaccggtgatgctggtgccgttgggccgggcaggcccgccccacccactcctggcccacccgccgacggcggcacgacgcctgcgtccgtgtgtggtcgtccggggaagccggcagccccgacccctggacttccgttcgagagcgcttgatcacttccgctggagtgcggctcgctcggcataccaccaccgactcccggtccggtagaggatttgccctggcctaaatggagatcttcggcggtgatttgttgcggagcaggagcttcctgagtattgaaaccatttgcgcgcgcccaactccgcgcgtcaccaccgacaccgtcagcatcaaggattttttgggtcgctgccatcatcttgtccacggcgtcgcgactggcgtttgcagcgtcggcattgcagcgcatctggactgcttgaatttccgctaacttctcaggaggcagcttcttcgatgccaggatttcgttgatctcgcggttgcccgtactggctatctccgacaaccggctccgcaaataatcggtggcatcagcggccgaattgaatgccgatgcctttgcctggtatttctcagcgagatctaggtgaaacttctcaccttgctggaatcgatcgatcagatcatctgctgtgtgcccttgattgtgggccgcaaacagcgtccactgagtacgcaaggtctgcgaataaatctgctgctccacgcatgattcgctccaatgctgagcaccagcgcgtagagccgtcgacggtgctggccaccaagggccaataagcgccgcggtccaggtcccaggcggaaggtcaagccccaccgcatacctttttcatcgcaatatccttagcgatcacatcatcgagcgcagcctgataattagcatcgctggcgactgcactgttgttgtttgcagtgaccgttccatacgctgccgccaatgctttcgcggcatcgcgacgatcggcatcaagtgcgaggttgtcagcaggcatgttgagcaggagggcaccgttagtatcggcgatccgcgctagcgcacgatcgttggcattagtgtcggtcgctactgcctgcgccactaacctataggtgtcgcataggtgcttttgcgcagctgcagtttcgctgagggtgtatttcggcaatgtggtcgccgcgggcaatcttgtagcggggcgaataagagcgattgccagtgcgccagcggcgactgcggccgtcacggctagggcaatcgccagccatggccgcgggcgtcgcgccggctgccaaggataggacggtggccgactacccacgggcggatggacgcttggcccctcaccaacgccagcaggtaggtcgcctaccatgtgccctcctactagtcagaacgcgcctgacgtgccatcaccgctacctctcaatagtgaggcaggcggcgggacgacagcaattcaccgtgcggtactgtgccgtgctagcccaactccccacccatatccccaccctgcgcactctgccagtcaagcgttcctcgcagcagcgggtggctcatatgcgcccaaggcgtatctccgaaaggctgggacacctgccgtgcgggtttacctataaggttgctcagctgcctccgcagaccgtcttcattgcagcgttcttgttattggcattgtccagcgcagattgccaggcgggatcatcgctacccgtcgccacgctggatgttgctgccacattgctatacgactcagccagggcaagcgcagcagcgcgatcaccgggggcaattgccggatttgcgtttactgcttcttccagcatcacggctccgtttaccgtcgccaggttcgcgcggtccgaatttttgccattcgtttcaatttgcacggcgcgagcggccaatctgtacgtgtcgcacaacttctgatgcgcagccgccgtctgttctgccgtgtacgaaggcgtcgtcgaagttgtcgaggaagccgttgacgaaccaccggtaggccgtgtcaacgcgaccaccagagccgcaccgcccagcagaacggccaccgcggccaaggcgaccgccggccatgtcctcgaacgaggcggctgcggaggaaaagctggtgcccactgcgttggattcggcggccccgtcattggcccctgcccagggcccggtggcaaatcccccaccatgcttcctcctaagtgtctgcaatcgcccttcgagaccgtatcccgaatactcggctccaatagttgaacagctaacggcgtaacgagcaatcaccgctactccgggtggttgcggtccagcatccgtgaaagcgtcgctgccaccgattctcggcgagggtgcagtccgtggttgacggtgcatgggtccctggcgatccggatggcacgtgcgatgaaaaggtgggagttgtaaggcttttagtgcctcaggcgcacaatggttgagccgatcacataaaggatcggcctccacaccaacgtttaggcgttcgatggcgacgggctggaactgggtcgcagcgcccgcatttcggtcgcgttctgctgatccatgttggtgaaaccgttggccgcgtggtgcgccttggtgccaacaccggtcagcgtctcgctgtgcgcctgcaggttctggacgtgttgttcgtgcgcgaccacgacggcactatggaatgcgtcggcggcggcgaagtcaccgaacatcccggacgctacggtcccgcccgccagttgatcggccccatcccgggcgtgaccgcccgcgcgatgggactggtttcctccggagtgcaaaaggtcggtatcgacgaacatcagcactccttccctgcgtcgaacctttgcattaagccttgtgatcaggctaaacgcggcgcaccgggcggtcaattcaccccgataccggccggtcagcagacaccccgcccaacggccaacggccgctagaacccgtgctcattggtgaccgagcgtgccggccgctcccattccggatcgaccaccaccggcatccggatctccacccgcggcagcgacagcgtccccaacggagtgtgcacccggccgagaatggacacccgcgccgcgtctcggtcgggcgccagcatgccttcggccgccaactggtcgccgcggccggtgacgatctcggtcatgttgtgcagcgcctcgctgcccacgtcgtagtagtgcgagtggtccgtgaaccacggcatgacgctgtgcgaaccggcaacttcggcgcggaaccgcacggccccgaaaccggcatgcgccgggtcggtgcccagcccggccagcggacccagcggaccgcccagcgtctcgttgagcccattgggcagaccgctacccgactcgccgatccagctgatcgcatcggtcgacgccgcacccacatacagcctgccgccgtcgaggtgaaagtccgcggcgctgtgcgccaaatccgttcccggacaaccggttagcaccgcgtcgttggcgcgcataccgctgttggcgaacgcgtcggccaccgtcgtcgacccgtaggaatggccgatgaccgtcacatgggcccggcttcccgcgtcgtgtgtggcggccagcccattgacgtcgccggccaacagcacaccggcctgccgcgccctccagggcgtgccgacctgttccaatttcgccggatcggtcacggcctgctcccagtgcgaatcgtcgaattccggtgcgtcataacccatccaggccagcaccgcggtggcgtggtggggggtcggcccgccgcgcttgcgtgtagaggttgatggcgtcgtcggctccgtcggacatccacccgccgcgcacgctgctgttggttcccggcacgacgaccgcggtgttgcgggccttgtccgggttgccgatggcgatgcccgccctgcccttgcccgcgaacgccagcgggtcgtaggcccacagcatcaacggcaacccagggtcgcacgccttgttgaggcagtcgttggtcttcaccgcgttctggtaccggacgatgtcggtggcgcacagcccgtaggacgccggattgctgaatatgtcgatatcccggttgcggagcacgttgtcgcgcagcgcctcaaccgatacaccccgcacccgggcgacggcttcgaccttgctcaggtcgtcagtcatcgtcgcccgattgaccgagtcacgcgcctcggcgggaataccgttgagattgcccaactcctgcggatgctgatcgatcaacaaacgctgctgagcgtcactcagcgaatcccaccaccacttgacctgctcagggccggtgtcggcgggcgggatcgacaactcgtcgacgcccctgacgtccgccgggtcgacaccatcggcctgcaggcgtgccagcgcgctgtgcaggagccgggaataactctcccgaacctgcttgagcaccaacgtgattgccttggtctcggtgacggcgctgtagcgcagctcctcggccgcgcagtgatcggcctcctcgagggcctggccgatctcgtcgtcgatggccgcgaggtcatattccagcgcttcgatgtaccacgtggacgtgcgttgggattcggccagcaccgcggcgatggtctccaaatcggttgcaatccgcggcaattgccggctctctacggctaacgcccgggtgacgcgctgcacctcggcggagtcgttgatcggcaccgcgccgtttcggtgattccacgacgcctcgaaccgacctcgggccgccgtaaacgcgacgtcggcctccgcggtgcttatccccgcgtcatggaacgcccgggccagggaggcgatctgcgccggacggccagcctgcaggcccgagtcgatcgaccacggatcaccgccggcctcggcgaccagaaacggaatgctcaagtggcgcagctgcatcggccgtatccccggcgcgacgccgcgtcagatcaccaccccgtactcacagtgcgctggcgccgtcggcgagaccgtcaccgtcggtgtcggtcagccggacgttccacttgccgtcaccgtcggtgtcgacgtatccggtcacaccggtctcgtcggtgcgcagcacccggtcggccagcccgttgccgtcggtatcgacgagccgggcgtcggggcggccgtggccgtcgaagtcgaccatgggcccgccggtgtgctcgacgccgtcgaggccgaaccagcgcagctgcccgttgcggtccacggccaccgcccacgttcccgaaccgtcgtcggtgaaataggcctcgggcgtgccgtcgttgtcgaggtccagcacggcgtgatcgacgaggccgtccccgtccagatccgccagtgcatcgtcgcgcagcccgtcgtggtcgaagtccagcccgatcgattcgaagcggccgtcgccgtcaaggtcgaggtcgggttgaccgtgccagatcgcggccgcgccgccgtcgcctgccaagcaatagtccacaaattgtcggacgcgcggccgcggctacccgttcccgcgagatcgccaccaggacagcagttctgcggtcgcctcgtcgggatccaacggtccccgctccagccgcagctccttcaggaaccgccacgcctccccgacctgagggccggccgggatgcccaggatctccatgatctggttgccgtccagatcggggcggacccgcgccaaatcctcctgagcggccagctcggcgatccgcgcctcgagccggtcataacttgcgtgcagccgagcggcccggcgcttgttgcgcgtcgtgcagtcggctcgcaccagcttgtgcagccggggcagcagcggcccggcgtcggtgacgtagcggcgcaccgccgaatcggtccacttgccgtcgccatagccgtggaaccgcagatgcagatacaccagctgcgagacgtcgtcgatcatctgcttggaatacttcaaggcgcgcaaccgttttcggaccatcttggcgccgaccacctcgtggtggtgaaagctcacgccgccgttgggctcgtggcgtcgggtggcgggcttgccgatgtcgtgcagcagcgcggcccagcgcagcaccagatccgggccgtcgtcttcgagggcgatcgcctgacgcaacacggtcagcgagtgctggtagacgtccttgtgctggtggtgttcgtcgatggccatctgcatgccgccgatctcgggcagcaccacctcacccattccgctgtgcaccagcagatcgatcccggccaccggatcgtcgccgagcaccagcttgtccagctcggcggccacccgttccgcgctgatccgggccagctgcggggccatccgctcgatcgcttcgcgcacccggggcgcgacggtgaagccgagttgcgacacgaaccgggccgcgcgcagcatccgcaacggatcgtcgccgaacgactcctccggtgtggcgggggtgtccagcacccgctggcgcagcgccgccaatccgcccagggggtccaggaattcgcccggtccgtcgggcgtgatccgcaccgccatggcgttggcggtgaaatcgcggcgcaccaggtcgtcttcgaggcgattgccgaagcgcacctggggatttcgggacacctggtcgtaggtgtcggcgcggaaggtggtgatctccaggcggcggtcgcccttgccgacgccgacggtgccgaattcgattccggtgtcccacaggttgtcggcccaccgccgcaggatttgctgcacctgctcggggcgcgcgtcggtggtgaagtccaggtcggggctcaaccggcccagcagggcatcgcgcaccgaaccgccgacgaggtagagctggtggcccgcggcgtcgaacgcagaacccagctcgcgcagcatcggcgcatgcttgttgagcgcgaccgcggcggcggtcagcagctcggcatcctgggcggcgtcaggcacgttcgatcagcctagtcggacctgcaccaaaagccggtgtgaggagcctcgcacgggatcaatggtgaattgacccggcgcggagcgtcagtagccttacgcgcagcggaaagggtgaacggcgggacgttgcggtgcatctccgatacataagcaaggccgcactgattatgttcgcgggcggagacccgtggaagatcaacgccacactgcagagcggccggccggcccagatctcgaaccttgcaaaagcgtttcatgacgccggacgatccacgggagaagccgaagccgcgttcaacctggcgcggggtcgcttcgagcaggcttggacacacgagaacgacgagaatccgatcaacggctcggccgaggttcaacggaccacgacctcactcagggtacaagcagctcaattaccgaaaatcggagccgatctggagaaggtcgcggccgcactggccgaggcccaacgatcgggcaggggcgagatttccacgctcgaaggcgcgctgcaagatctcgacaatcaagtcggtgaggcggtcgagctggagaagaaccctcagttgacggcttcggagaggcagttgctggatcactacatcgacggactcgagaagcatgcgatcgatgacaccaaggcatcagtagccaatctgacgcgaatccgcgatcaatattctcagcagctgcacacttctatggacaacctgcgtgagcaggacagctacgacccgccaatccaggcatttgacggcaacgttccggaatcgccctcgcaggaccaacgtcgtcacaaccagatcgaggccttcaaacaggtctttggccgtgaaccatcttcggccgcagactgggagaccgctgccgcgctggattcgcagacctatgactccaagttcaacggcgccaaatcggagatccgggtggtcaggatccgcccggtacccgggcagggagtggtccgtgtctcgcagtggatcgaacaacgcgatgtgacgagttccctcactggaaatcgggaccttggtaacaatcgtggggccgatcaacattttgaccccgaggacaccaaagtaacgacctacatcgactacgaaaacgggctcgtgatcctgcgtcagaatccctccgtcgaggagactcccaccggggcgccgggtacggtcaaggtcggcacgccgaaaggcagcgtgactcagttagctgacgggtcggttcggatcaaatacgacgcgggcaatcccttcgcgccaagcattaccgctgatacgaacggcccgtttgcgggccacaccatcactgtaaacggtgacctagcattcaccccgggaccggaaggcgtccacgtgaatggcacgcgcactgattatccctccctcgaggcttatcaggactttccaggtggcagtacccgcacgttactaatcgacccagcgcagtcaactagctcggtgggaccgatgttcaaccttccgttccaccacgacgtcggcccattgggtggtagagcattcgcgccgtttgacagtgggggttggaacctcaaatacgacgtgccagcgccgctgcccgcgacggagttcggcccggttacccgtgccccgtcgattcctctgctgccaagcggagtagaggtccggcctgatcgcttactgacaggaaagctactccgatgccttcgttcacccgcgcaacaccactcgacgccggcgcctggcgcacagcaacctggtcggcaccccttgtcgtccaactgatattggcaatgctgcttgtcgccatgtggttgctgggcaagtggccgttcgaaacgcatagtgcgtacgccggtgaacgaacatggatgctgacctcgaccgtcattacgactttggtggcgctgttaatcggcgtcgcgttcctgaggtccccgtcaccacgtaatcgtggtcttggggtcagcattgcaagctgctcggtggtcgtgctcgccggcggaacgcttttcgcttacatattcctgcgctaaaggccaccgatgacagacaaacgttttgtgggcgaaccaagcgatcgatacgggccactgactttcgccatagctatagtccacgtctttgtggtcgatctcatcacctggatcatcgtcgtgccgatgtggcccttcgtcgtcttcgttcttccgataacgctggcatacatcgctgtcggcgccattattgcgagggcaccgggcagatgggggcaggtaggccgcgggatgatgattggcagcctgtcaggaccaatctcaattctgattttcattcccgcttttattgtcgcccacgcgataggcccgatctaaccgaagtcatgagctggacacagcgcaggacttgcccacgcccacccagcggcgagtatgtccaggagaacatgccgtgccagctactatcgcttgggtgtcggacggcgaacaaggcaaaccacgtcggcgccgggggcggcgccgcggccgtggtgctgcaacgtcgtcggagaaacagaccaacggtcaactgaccggcgactcgaccgccaccaagccccgccgatcccgtgccgcgcgccgcgccccggatcggctgcgcaccgtgcacgaaacctccgccggcggcctggtcatcgacggcctggacgggccgcgcgaatcacaggtcgccgccctgatcgggcgcatcgaccggcgcggccgcatgctgtggtcgctgcccaaagggcacatcgagctgggtgagaccgccgaacagaccgcgatcagagaagtagccgaagagaccggcatccggggcagcgtgctggccgcgctgggccgcatcgactactggttcgtcaccgacggccggcgcgtgcacaagaccgtgcaccactatctaatgcgcttctccggcggggaactctccgacgaggacctcgaggtcgctgaggtcgcctgggtgccgatgcgcgagctgccgtcccggctggcctacgccgacgaacgccggctggcccgggtcgccgacgagctgatcgacaagctgcaaagcgacggccctgccgcgcttccgccgctgccgcccagctccccgcgccgccgcccgcagacgcattcccggacgcggcattcggagacgcggcattcggacaaaccggccaccggccggaagaacggccacggaccggggccgtgacggcgccgcgtttgtgttgggccggcgggttgcgcatcgccgccgtgctcggcgtcctggccgggcttgcggtgctcaccgggccggtgacaccgcgcgcggtcgccggcgagccgggtgtgacgccgttcgtccgggtgcgcatcgaccaggtcacccccgacgtcgtcaccaccaccagcccgcccgtcgtcacggtcagcggcatggtgaccaacatcggcgaccgacccgtccgcgacgtcatggtccgcctcgagcacgccggcccggtcaccgcgtcggcgggtttgcgcaccagcctggacggcgacaccgaccagtaccaggccgccgccgactttctcaccgtcgcacccgaactgcagcgcgggcaggaggtcggcttcaccctgtcggcgccgctgcgcgcgctgaccaagcagtcgctgggcgtcgagaagcccggcatctatcccgtcctggtcaacgtcaacggcacgcccgactacggcgcgcccgcgcggctggacaacgcgcgcttcctgctgcccgtggtgggggtgccgccggaccgcgccgacgacctcggctcggccgtcgcacccgacacctccaaaccggtggggatcaccatgctgtggccactggccgaccggccccggctggcccccggcgtgccgggcggcaccatccccgtccgcctggtcgacgacgacctggccacctcgctggccagcggtggccggctcgacatcctactggccgcggccgaggtcgccaccagccacgacgtcgaccccgacggcgccgtcggccgcgcgctgtgcctggcggtcgacccggatctgctggtcaccgtcaacgccatgaccgcgggctacgtcgtctccgactcccccgacgggccggcccaactgcccggcacccccacccacccgggcacggggcaggccaccgcgaccgaatggctcaaccggctgcgggcactggcgcaccgcacctgcgtggccccgctgccctacgcgcaggccgacctcgatgccctgcagcgcgtcaacgacccgggcctcagcaacaccgccctcaccagcgtcaacagcatcgtcgacaagatcctggacgtcccctccacccgcggcgccacgctgatgcccgacgggcggctgaccggccgggcggtcaaactgctcggcgccaaccagaccaccgtcgcggtcaccgccgccgacctgtcggccggcgacgcccagggctcctcggagaccagcgtcgacaccgcgccgcggcgggtgtccccgcaggtcgtggcggcgccgttcgacccggccgtcggggccgcgctggccggcgccggcgtcaaccccgaagtgccgacctacctcgactcgtcgctgaccgttcggctggctcacgattcggtgaccgcccgccgccaggacgcgctgggctccatgttctggcacgcgctgcgccacgacgacaccccccgcacccagctcctggtccccccggcgacctggaatctgcaggccgacgatgcgcaggtgatcttgaccgcgctgaccaccagcatccgctccggtctggcggtgcctcgcccgctgccggcggtgatcggcgaagccacccaggccgcacaaaccggcgccccaccgtcggaccaggtcagcgcggacggctcggcccgcgggcagttcaacgacgacgtcaccggcgcgatcaccggtcaggtcggccggctgtgggggctgacgtcggcgctgatgaccgacgaccgcaccgggctgaccggcgtgcagtacaccgcgccgctgcgcgaggacatgctgcgcgcgctgagccaatccgaaccgccggacagccgcaacgggctggcccagcagcggctggcggtggtcggcaagacgatcaacgacctgttcggcgccgtgacgatcgtcaacccgggtggctcctacaccctggccaccgagcacagtccgctgccgctggcgctgcacaacggcctggccgtgccgatccgggtgcgggtgcacgtggacgccccgcccggcatgaacgtcaccgacgtcggggtgatcgagctgccgccggggtacctgccgctgcggatcccgatcgaggtgaacttcacccagcgggtcgcggtcgacgtgaccttgcggaccgccgacgggatgcggctgggcgaaccggtgcggttgtcggtgcactccaacgcctacggcaaggtgctgttcgccatcaccctgtccgccgcggcggtgctggtgctgctggcgggccggcggctgtggcaccgcttccgcggccagcccgatcgcgccgacctggaccgccccgatccccccgatgcccggcacgccgacccgcacgacctcgccgacccgcgcgtcgaacaagagcaccgcgtatgaaccccgcctaccggcaggccgcaccgcaccaccgccgcctgcccgagccgccgcggcgtccccgcatgccgggctccccgccgaccgggccgctgccgcccgtccccgccggaatcgaccggcgccgcccggagctgtcggactcggcgctggtgtcgcggtcgtgggcgatggcgttcgcgacgttggtcagccgtcttaccggcttcgcccgggtggtgctgctggccgcgatcctgggcgcggcgctgtccagcgcgttctcggtggccaatcagctgcccaacctggtggcggccctggtgctggaggcgacgttcaccgcgatcttcgtgccggtgctggcccgcgccgagcagagcgaccccgacggcggcgccgcgttcgtgcggcgcctggtcacgctgacgaccgccctgctgatcgtcgcgacggcgctgtcggtggcggccgccccgctgctggtacggctgatgctgggccgcaccccgcaggtcaacgagccgctcaccgtcgccttcgcctacctgctgctgccccaggtcctggcctacgggctcacttcggtgttcatggcaatcctgaacacccgcaacgtgtttgggccgacagcgtgggcgccggtggtcaacaatgtcgtcgccctcgccaccctggcggtgtacgcgctggtgcccggcgagctgtcggtggatccggtgcggatgggcaacgccaagctgctggtgctggccgtcggcaccacgctgggcgtgttcgcccagaccggggtgctgctggtggcgctgcgccgccagcacgtcgacctgcgtccgctgtggggaatcgaccagcggctcaagcgattcggcaccatggccgccgccatggtgctctacgtgctgatcagccagctcggcctggtggtcggaaaccagatcgccagcaccgcagccgcttccggcccggcgatctacaactacacctggctggtgctgatgctgccgttcggcatgatcggcgtgacggtgctgaccgtggtgatgccgcggctgagccgcaacgccgccgccgacgacacccgggccgtgctggccgacctgtcgctggccacccggctgaccctgatcacgctgatcccgatcgtggcgttcatgaccgtcggcggccccgcgatgggcagcgcgctgttcgcctacggccacttcggcgacgtcgacgccggctacctgggcgccgcgatcgccctatccgcgttcaccctgatcccctacggcctggtgctgctgcagctgcgggtgttctacgcccgcgaacagccctggaccccgatcgtgatcatcctggtcatcacggcggtcaagatcctcggttcaatgctggcgccgcacctcaccggcgaccccaagctggtggccggcttcctcggtctggccaacggcgtcggcttcctggccggcgcggtcatcggctacgtcctgctgcgccgcacgctgctgccgggcggcggccacctgatcggggtcggcgaggtgcgcaccatcctggtcacgctgaccgccgccatgctggccggactggtcgcgcacgtggccgaccggctgctggggctgggcgcgctgacggcgcacggcggcggtgccggctcgctgctgcgcctgctggtgctggcgctcatcatggtgccgatcacggccgcggtgatgctgcgcgcgcaggttcccgaagcccgggccgccctggacgccgtccgcttccgcatcacgggccggggaccgcggccccgcaaacccgctgcgccggatcgatcgtctcaccggcgcccggtcacgtaccctgagcagaggaattcgtccccgcctggggtaaatgcggtccaggagccgatccggcgcaggcctccggagcgggcaaaccgagcccggctagtgaaaggaccggaggtgaccgaccgcccgatggagagcgccgcatccagcgccgggcccggcacagggtcgggtgctccgcggccggtcgccgacgacttccagcccgacattcccgccgaccagcccgaccgcccccgcaaggccgacccgcggcccgccgaccagaaaaacggcgacgtcgggacccgccgcggcccgttagacgtgccccgcgagcgcaccgccgactcgtcgaccgacgacgtccacctggtccccggcgcacgcatcgccggcggccggtaccggttgctggtgttccacggcggcgccccgccgctgcagttctggcaggccctcgacaccgccctggaccggcaggtcgcgctgaccttcgtcgatcccgaccgcgccctgcccgacgaggtgctgcaggagatcctgtcccgcacgctgcggctcagccgcatcgacaagcccggcatcgcccgggtgctcgacgtggtgcacaccggctccggcggcctggtggtctcggagtggatccgcggcggatcgctgcaggaggtcgccgacaccgcgccgtcaccggtgggcgccgtacgggccatgcagtcgctggccgccgccgccgacgcggcgcaccgcgccggcgtcgccctgtcgatcgatcacccgagccgggtgcgggtcagcatcgaaggcgacgtggtgctggcctacccggcgaccatgcccgacgccaacccgcaggacgacatccgcggtatcggggccgcgctgtatgcgctgctggtcaatcggtggccgctggccgagagcggggtgcgcagcgggctcgcaccggccgaacgcgactcctcgggcaaccccgtcgaaccgatggccatcgaccgcgacattcccttccagatctccgcggtcgccgtccgggcggtccaggatgacggcggaatccgcagtgcctcaacgcttttgaacctgcttcagcaggccaccgcggtcgccgaccgcaccgaggtgctcgggccgatcgacgattcgccctcgccgtcgacggcgctcatctcgcccgggaacgatccggcgaccttcgcgcggcggcggcgcaacgtgctcatcggggtgggcgccggcctggccgtcctggtcgcggcgctgctggtgctggcgtcgatcgtgagcaagatcttcggcaacgtcggcggcggcctcaacaaggacgagctgggcctcaatgggccctcgtcgtccacgtcggcgccgcagaccaccacgtccacggccgccggcagcgtcgtcaaacccacccgggccagcgtcttctcccccgacggcgacgccgacaaccccggcaccgccggccaggcgatcgacggcgatccctccaccgcctgggcgaccgaggtctacaccgacgccgtgccgttccccagtttcaaacagggcgagggcctgatcctgcagctgcccagcccgaccgtggtcggccaggtcagcatcgacacccccagcaccgggaccaaggtggagatccgggccgcgtcgtccccgacaccggccggcctcaacgacacgaccgtgctagccccggccttcaccctcaagccgggccacaacgtcatcccggtgcgggccggttcgccgacgtcgaatctgctggtgtggatctcgacgctgggcaccaccaacggcaagagccaggccggattttccgagatcacggtccaggccgcgtcctgaatcccggcgcgtcgcaagcactcacatgagcgccggcgagtgaagtgccgcgggatacccgattggttactgtccggccgtgggcttcggaagaaacggcaacggtgaccgcagcgacgccgagctgctggcagcccacgtggccggcgaccggtacgccttcggcgagctgttcgtccggcatcagcgccacctgcaccggctggcccggctcacgacgcgcagccccgaggacgccgaagacgcgctgcaggacgccatgctctcggcacaccgcggcgcgggcgcgttccggcatgacgcggccgtcggcagctggctgcaccgcatcgtggtgaacgcctgcctggaccggctgcgccgcaccaaggcccacccgacggtcccgctggaagacatctatccggtcgccgatcgcacggcccaggtggagacgacgctggcggtgcagcgcgccctgatgcggctgccggtcgaacaacgcgcggcgatcgtcgccgtcgacatgcagggctattcggtggccgacaccgcgcggctgctcggcgttgccgagggcaccgtcaagagccggtgcgcccgcgcccgggtgcggctcgccgaactgctgggctatctcgatgccggggcccacgccgctgccgagggcgccgccggccaggcctgacggcggccccgcactggccgtccgtggcgatcgctgcggccatgacggacactgggtccgatggctacagcgggcaacgacgcggcggatcaccgcaacgcggaatccgaccctccgctgaccgccgagcttctggccgacctgcaggccggcgtgctcgacgcgttgaaccgggttcgccgcgaggtcgccgccctcggcgccgatccggcctcgccacccgaccctcccccgcaggtcaccgcccgcgtcgccgcggcgctgcgctccgccgaacccgtcggggcgaccccgcgggccgctcattcggcccgcccgccgctgcgcacggcccgcgccattgccgcggtcgccgggttgggcgcggcgctggccgcgatcggcgtcggcaccgtggcgttgctgcgcacgcccgcacccgcccccagcacccctaccgacatcgagcacatcacggtgtcgacgccgccgatgcagatcccgctctcgcgcgccgagatcctcggcctgctcgaccgcagccccgacttcgggccgctcagcgacccggcccggcgcgcgtcgtgcctgaccggcctgggctacccggcgtccacgccggtgctgggggcgcgtccggtcgccatcaacgcccgccccggcgtggtcctggtgatccccggcgacagcccgcacgtcctgaccgtctacgcggtctcggcgaactgcagcgccgccgacaccgggctgttggccaacaccgaagtgccccgcccctaatgtggtgcaaggggtgccggccgtgttgttcgcgacagcggggaacagccatccctaccctggcgtttataccgatccagagaccatcgctcgaaaggttttcatgaccgccgacactgtccacgacgtgatcatcattggttcgggtcccgcgggctacaccgccgcgttgtacaccgcgcgggcgcagctggcgccggtggtgttcgaggggacctcgttcggtggggcgttgatgaccaccaccgaggtggagaactaccccggtttccgcgacgggatcacgggcccggagttgatggatcagatgcgtgagcaggcgctgcggttcggcgccgatctgcggatggaagacgtcgagtcggtctcgctggccggtccggtcaagtcggtgacgacggccgagggtgagacggtgcgggcgcgggcggtgatcctggccatgggcgccgccgcgcggtatctcggtgtgcccggcgagcaggacctgctggggcgcggtgtcagttcgtgtgcgacgtgcgacgggttcttcttcaaggaccaggacatcgcggtcatcgggggcggggattcggcgatggaggaggccacgttcctgacgcggttcgcccgcagcgtcacgctggtgcaccgccgcgaggagttccgggcgtcgcggatcatgctggagcgggcgcgcgccaacgacaagatcaccatcgtgaccaacaaggcggtcgaggcggtagagggctcggagacggtgacgggtttgcggttgcgcgacacggtcaccggcgagacgtcgacgttggcggtcaccggggtgttcgtggcgatcggtcacgacccgcgttcggagctggtgcgcgacgtgctggacaccgaccccgacggctatgtgttggtgcagggccgcaccacggccacctcgattccgggggtgttcgccgccggggacctggtggaccgcacctaccgtcaggccgtcaccgccgccggcagcggttgcgcggcggctatcgacgccgaacgctggctcgccgaacatgccgagtccagtgcggccgcgcaaggcgatgccaccgaattcccgggcagtaccgacacattgattggagcaccgcaatgaccgacgccgaaaaggccagcgccacaatagaagtctccgacgcatcgttttccaccgatgtgttggccagcaataagcctgtgctggttgacttttgggcgacatggtgtggtccctgcaagatggttgcgccggtgctcgaggaaatcgccagcgagcgcggcgatcacctcaccgtcgccaagctcgacgtcgacgccaacccggaaaccgcccaaaacttccaggtggtctccattcccaccctgatcctgttcaaggacggccagcccgtgaagcggatcgtcggcgccaagggcaaggcggcgctgctgcgtgagctttccgacgcggttcccaacctcggctgatcttcttttcatttcgtcgcaccacgccccgcggatggcctggggttttcccgaattcacgaagcgtctgcgacaatacggttagctgttgccgctatgcgagccagtcagtttgtcccggagggcccttggtatgtcgagtccgcgccgcgaatacggcgacgcgctgcgctgtggtgaccgcagcgctgctgtgaccgagatccgggccacgctcgcctcgttagggctgctggccagcgccgatgaggatctcagcaccggccggcacgtggccctggaactcttcgacgccgagctcgaccaggccgtccgcgcctttcaacagcatcgcggcctgctggtggacggcatcgtcggggaagcgacctaccgggcgctcaaggaggcgtcctaccggctcggcgcccgcacgctgtatcaccaattcggcgcgccgctttacggcgacgacgtcgcgacgctgcaggcccggctgcaggatctcggtttctacaccggcctggtcgacggctacttcgggttgcagacccacaacgctttgatgtcgtatcagcgcgagtacgggttgtccgccgacggcatctgcggcccggaaacgttgcgctcgttgtattttctgagttcgcgggtcaccggcggatcgccgcacgcgctgcgcgaggaggagctggtccgccgatcgggccccaaactgtccggcaagcgaatcatcatcgacccgggccgcggcggcgccgaccacggcatgatcatgcagggtccgtccggcccgatcagcgaagcagatgtgttgtgggacttggcaagccggctcgagggccggatgaccgcgatcggcatggagaccttcctgtcgcggccggtcaaccgcagcccgctggatgccgaacgcgcggccaccgccaacaatgtcggcgccgacctgatgatcagcctgcgctgcgaagctcaaaaaagccccgccgccaacggggtggcatcctttcacttcggcaactcgcacggctcggtatccaccatcgggcgcaacctcgccgacttcatccaacgagaagtggtggcccgcaccggtttacgggactgccgaacgcacggccggacgtgggatctgctgcggctgacccgcatgcccacggttcaggtcgacgtcggctacgtcaccaacccgcacgaccgcgcgatgctggtgtccacccagacccgcgatgcgatcgccgagggaatcctcgccgcggtcaagcggctctacctgttgggcaaaaacgaccgtcccacaggcacattcactttcgccgagttactggcccacgaattgtcggtggagcgcaccagccagatgggcggttcctgaaccgcaccggccgctagtcgggcggggcggttttcaatgcgttcgccggcgtggacgcggccccgaccggctgctcgaggcgggcgctctccagcagacgctccagcgccgcctcgacttcggccttccacccgagacccttgtcgagctcgagccgtaaccgcgggaagtacgtatgtggcgctaccacaacgaatcccgcgtctttgaggaactccgcgtccatcacgcagtggtccaccgagcaatcaccgacggcctccaacaccggacgcagatcgggacccaccaggcgcggatcctgtagctccgacgcggccggggtgcggccgaacgcctcgagggcgcgcaccccgcgacggaccagttcgtcaatcacccgggcgagcaaggcgtgcggcaggtcgtcggcggccggcccgggttcgattcccatggacgtcaacagcaccgcgtccgcggacaccggtccggtcggaaaacgttgggcccgcggcaccgctcgcggcaccgctcgcggcggggcatagaacacatagcccagacacggcggctcggcctggcttcgctcgtcggggatcgccgtcgccacctgaccgcagcacccccactccagcatcaccatcgacagccacgcttccttttcgaactcggcgtcggcgaggtggtcgtggttaccgaggacggcgggatcgacctcccagaagacgcaccggcgggcgtgtttgggaagctgctcgaaggcctcgagccgcagcggcgtgattcgggcggacactagcctcctggctcctgtgcggtactgcagcgatctgcaccggcaacccctccaggataggagaggtggcgatgatcgggctagctttggcccggccgcccggcccggcgccggcggaccgccgcccgggacggatcagcccctgtcggatttcgaaatttgttggtgcacatgcgatttcgccgagccacccggcaccggccgggcggattcgggcccgcaccgatcgcggcgtcacagtgacgtaattacaccgggtcctaggtcacggtttcggcggggccatcacgtcgatgatccgctgcagatcgtccaccgacccgaactcgaccacgatcttgcccttgcgtttgcccagactgaccgtgacccgcgtgtcgaaggccgtggagagccggtcagcaacgtcttgcaggccgggcatctggatcggcttgcgccgcggcggcgtcggcgtcgtcgtgccggcccggttggccagggtgaccgcctcctcggtggcgcgcaccgacagaccctcggcgacgatccgggtggcgagctcctcctgcgcctcggggccggcttccagcgacagcagcgcccgggcgtgaccggcggacagcaccccggcggccacccgccgctgcaccgcgatcggcagcttgagcaaccggatcatgttggtgatcagcggccgggaccggccgatgcgggcggcgagttcgtcgtgggtgacgccgaattcgtcgagcagctgttggtaggcggccgcctcttccagggggttcaactgcacccggtggatgttctccaacaacgcgtctcgcagcaggttgtcgtcacccgtctcgcgcacgatggcgggaatggtggccagcccggcctcctgggccgcacgccagcgccgctcccccatcacgatctggtagcgggcgccgctggccgactccttgatggcccgcaccacgatcggctgcaaaaggccgaactcgcggatggagtgcaccagttcggcgagcgcctcctcgtcgaagacctgccgcggctgtcgggggttgcgttcgatgtcggccggcgagatctcgcggtagaccgcacccacgggcgacgcctcctgcggcgccggtcccccgatcaagacgtccgcggcggcgtcgcccatccgcggacccagcgtcgccgggccggcgtcgccctcggcggggccggtgggaatcagcgaagccaggccccggccgaggccgcccttcttacgtaacggctgcgtcatggtcgtcccttcacggatgccttcacgggtggtggtcaatcacgctcggcgagttcgcggctcgcatcgagatagctcatcgccccgcgcgacccggggtcgtagtcgatgatggtcatgctgtagccgggcgcctcggacaccttgacgctgcgcgggatcaccgtccgcagcaccttgctgccgaagtagcggcgcacctcttcggccacctggtccgcgagcttggtgcggccgtcgtacatggtcagcaccacggtgctcacttcgagctgcgggttgaggtgcgccttcaccatctcgatgttgcgcatcagctgcgacacgccctcgagggcgtagtactcgcactggatcgggatcatcacctccggggcggcgacgagcgcgttgatggtcagcagcccgagcgacggtgggcagtcgatgaagacgcagtcgaagtcgaggttgtccagatcggccagcgcggtccgcagccggttctcccgcgccaccatgctcaccaactcgatctcggcgccggccaggtcgatggtcgccgggatgcagaacagtcgctcgttgtgcgggctctgccgcaacgcgtcgtgcaccgacacctcgccgagcaggacctcgtaggacgacggcgtacccgactgccgatccgtgatcccgagcgcggtgctggcgttgccctgcgggtcgaggtcgatgacgagggttttgagtccctgcagggcgagcgcagcggcgaggttgacggcggtcgtcgtcttgcccacgccgcccttctggttcgcgacggtgaagacgcggcgatgcttgggccggcgtagcggcggataggtggtgtggaggatccgcatcgcgcgctcggccgccgcgccgatcggggtgtcgaattcgtccgctgtttcacgtgaaacattggccggcggcgaggtcgacgcggcggcggatgacggcggcgccgtggccgcggtcggcggcggcgccggggatccaaccgccgacgccccccgcgtgcccgacggggcccccggcccaatgggtgccgccggggtgtgcgtcgcgctcggtgcgtcgggcgcgggcgtcgccgcgccctcccgcgcctccgaagaagccaccggccaatctcctgaagaagtcatcgggttccggccttcccggtccgtgccgacttggggtgcggcggctttgcgcgtcgagctgaaactacggttgcggggggacgcaaatagttcgcgccacatgtcaccaccctgacatcagcggcgcccgatgctgtcatcacacgccggtatcggtcaacttcctccgccgcccgctcccccttgatggcgagcatccggccgtcgtggcgtagcaacggcatactccacttcgtcagcttgtccaacgctgcaaccgctcgcgacaccgccgcgtccctctccccgaaccggtcccgcacgggccgctcttccgcgcgcccgcggaccacctcgacggctaaccctagttcgtccaccacctcggtgagaaactcgctgcgccgcaagagcggctccagcaataccacctcgagatcgggtcgcgcgatggccaacgggatgccgggcagccccgccccgctgccgatgtcgatgatccgatcaccgcggcccaggagttcggcgaccgccgcgctgttgaggatgtgacggtcccagatgcggtcgacttcccgcgggccgagcaggccccgctcgacacccgcggtgccgaggacttccgcgtaccgctgcgcggtcgcgaggcgggggccgaacagcgccgcggcggactcgggtgcggcaccgagctccgcgacgggtggcacctccggatcgcccgcagccggctcgaccggaccgacatgtttcacgtgaaacatcccctggttggcgtgtgcaccttcaacgttcggacggccgccacacggcagcgaactacaccgctgtaacttcgggccgtcagtcgtgcaggacgaccacgcgtcgcgacggctcgacgccctcgctttcgctgtgcaccccgggcaccgccgcgaccgcgtcgtgcacgatcttgcgctcgaacggggtcatcggcgcgagctcttcgcgttgccccgattcgagcacccgccgcgccaccttgtcgcccagcgccgcgagttcctcccggcgccgccgacgccagctcgcgatgtcgagcatcagccggctccgcacgccggtcttctggtgcacggcgagccgggtgagctcctgcagcgcatcgagaacctcgccgccgcggcccaccaacttgttcaggtcgtcgctgccgtcgatgctcaccacagcccggctgccctcgacgtccaagtcgatgtcgccgtcgaagtccaacaggtccagcagctcctccaggtagtcgccggcgatctcgccctcggcgaccaacccgctcctccaggtcgtcggcctcgtcgccgtcggccggttccggctcggcgggcgctgcggtgtcgagctcgcgttcggtggtgtcggcgtctgccatgtctttatctccctcatccatgggccgcagcccagttagggtcgccctgccgcggcggccccgatagcttgtccgccccgatcagcgtttgcgcttcttcggtcgcgccccgggacgcggggtgcggctcggcgcgtcgctgcccccgccggcttggccctcggtggcgccggcgtccggctgtgccgcgtctgcatccacaccgttgcccgcgcccgccttcaggttccgcttcggcttggcgcccggcgccggggcattggccgcgcggcgctgaatcgcttcctgcttcttggcttcgtcttccttttcgatcatgccgaacacgtagtgctgctgaccgaacgtccagatgttgttggcgaaccagtacaggatgatggccagcggcaggaacggcccaccgaccaccacgccgagcggaaacacgtacagcgcaagtttgttcatcatcgccgtctgcgggttggcggccgcctcggggctttggcgtgccaccgacgcccggctgttgaagtacgttgcgacgccggccaggatcatcaccggcaggccgaccgcgatcaccgccgggcggctgaaatacgtgaacgcgtccagcccggtgcgctgggtcatgaacgcgccgatcggtgcgccgaacaaattggcgtccaggaagtgccccacatcggtcggggtgaagacgtagtttccggtcagccggttctgcaccaccgacaggtgcggttgcccgaacccgccggtggttcggttgaacgaccgcagcacgtgatacagaccgaggaacaccgggatctgggccagcatcggcaggcagcccaggatcggattgaacccgtgctcgcgctgcagcttctgcatctccaacgccatgcgctgccggtccttgccgtacttcttctgcagcgccttgatctgtggttgcagctcctgcatctgccgggtggtgcggatctgccgcacgaacggcttgtacagcagcgcccgcagggtgaacaccaagaacatcaccgacagcgcccaggcgaagaagttcgacggcccgagcatggcggcgaacaacttgtaccagacccacatgatccacgacaccgggtagtagacgaagtcgaggctgaagaaatcaaacaagagatccactctcccctcgcgtcgctcggaccgcccaagcgtcgctggcatcttggcaattcacccggcatccggggcgctcggggatcgggtcccagccgccctggtgccatggtccgcacttggcgagtctggccgcggccagccagctcccccggatcaggccgtactcgtccagcgcgtccaccgcgtactggctgcaggtcggaacgaagcgacaggtcgccggacgtagcggcgacaccatatgccggtagagctgaatcaggaaaatcagtccgcgggcgacggttcggccggcgccgcgaatggccgcgcccgaccgcgccggtccggtcaccgcccggatcccgccggcatgcgccgcaggcaccgctgcagttcctgcgccaggcgcgccgacgacacagtccggctgccgggcagcgcgcgaatcaccagccggtcggatggttggagttcgccgagcaggggccgggccacgtgacgcagccggcgggccacgcggtgtcgttgcaccgccgtcccgacggccttcccgacgaccagcccgacccgtgggcccgcggattcgtcgtcgggttcggagccgcgccggaggtggacaacgatgtcgggctgcgccatgcgggttccgtgcttcaccgtcgcgtcaaactcggttgacctcgtcatgcggttgcgtgcgggaagcaccgcgaaagacctgacgtgcgatcaggcagagagcgcgcggcgacccttgcggcgccgaccggacacgatcgcgcgcccggcgcgcgtgcgcatccgcaaccggaagccatgcacgcgggctcggcgccggttattcggctggaaggtccgcttgcccttggccacgacgttctcctcgttgtttgccgtccggccgctcagacggttcgcttcgggctcgtctgcggttcgaccggagggtggtcttgctgctcctggccggcgcggtccccaagtggtgctgggtcgcagccgtatcgccgactttcgggcgactgtttgagggtactgaccagccttcgcctggtcaaacctggcctgccgcaacgcagccgcgcccggccggtaccgagatttcgcattccgctcccgccagccactcgggtcaactaacctaccgagccgaagcaagccccagtcaccctaaacgaccggattggagtacagcggaacggttggcagccgcacggaaaactgttagcttctgccaagtcgttttagactacgaacagcgctcgacaacgaagcgaggatggtagatcaactagctgcctagacaacctttttcgggttttcttccagcgcggagatcgcgggccgtcgccggtaggttgtggctcgcatacgatcatcctgtccacacctgtgtataactatgtggacagttgttttgtcgccaagcgtgagttgtacttcgacccgggacgttcgagaaccagggagatgcgtcgttggccgatgaccccggttcaagcttcaccacggtgtggaatgcggtcgtttcggagctcaacggcgagcccgtcgccgacggcggagccgccaaccgcacgactctggtcactcccctcacccctcagcaaagagcgtggctcaatctggtccgcccgctgaccatcgtcgaggggtttgctctgctgtcggtgccgagcagtttcgtgcagaacgagatcgaacggcacctgcgcgccccgatcaccgacgcgctcagccgccgcctgggtcagcagatccagctgggagtccgcatcgctcccccacccgacgacgtcgaggacgcgcccatcccgccggccgagccgttccccgacaccgacgccgccctgtccgccgacgacggcgccgacggcgagccggtggagaacggggagccggtcaccgacacccagcccggctggcccaactacttcaccgagcggccgcacgccatcgatcccgccgtcgccgccggaacgagcctcaaccgccgctacaccttcgacacgttcgtgatcggggcgtccaaccggttcgcgcacgccgccgccctggccatcgccgaagcaccggcccgcgcctacaacccgttgttcatctggggcgagtccggtctgggcaagacgcacctgctgcacgccgccggcaattacgcgcaacggctcttccccggcatgcgggtcaagtacgtctccaccgaggaattcacgaacgacttcatcaactcgctgcgcgacgaccgcaaggtcgccttcaagcgcagctatcgcgacgtcgacgtgctcctggtcgatgacatccaattcatcgagggcaaggaaggcatccaggaggagttcttccacaccttcaacacgctgcacaacgccaacaagcagatcgtcatctcctccgaccggccgcccaaacagctggccaccctggaagaccggctgcgaacccggttcgagtggggcctgatcaccgacgtgcagccccccgaactcgaaacccgcatcgcgatcctgcgcaagaaggcgcagatggagcgcctggcggtgcccgacgacgtgctggaactcatcgccagcagcatcgagcgcaacatccgcgaactcgagggcgccctgatccgggtcaccgcgttcgcctcgctgaacaagaccccgatcgacaagtcgctggccgagatcgtgctgcgcgatttgattgccgacgccagcaccatgcagatcagcgcggccaccatcatggccgccaccgccgaatacttcgacaccaccgtcgaggaactgcgcgggccgggcaagacccgggcgctggcccagtcccgccaaatcgcgatgtacctgtgccgcgagctcacggatctgtcgctgcccaagatcgggcaggccttcggccgcgaccacaccacggtgatgtacgcccagcgcaagatcctgtccgagatggccgagcgacgcgaggtgttcgatcacgtcaaggagctcaccactcgcattcgtcagcgctccaagcgctgaatcacgccgcggccccggcctttccggcccccggcccgcaattttttcaccccgtcccggaattttttccgagaaacttctcacccgtttgtcacaccggtcacacccagggcatgtgcccagagctgtgcacaacaccgggaggcagcggtgtagtaccaccgcgtacgtgcacagcccgcgttcgtccccatcggctcaacatgtcacccacagccgcccccaccgtgatccacaccccggcgcaccgcgcgagctgcggcgggagaccgctgtccccaaaatgcacaagccttattactgttactgagatctcttcatcggttcttctttgaaatacagccctggggacgttcggtgcacaccctgcgtcgcggccgtcgtcagcccggtttgtcggcctttgcgattagctttcaagatggccccagaggatctacggttgttcttcgactgccgttgcggtcgtcgtcgacgcctcgcgtgtcgccggcgccgtgacgggccccatgctagcggggggaggctagccaatggatccgacaacgctgagtaggtgaagggacgctatggacgcggcgacgacaacggctggcctcagcgacttgaagtttcgtttagtgcgggagtctttcgccgacgcggtgtcgtgggtggccaagagcttgccgtcgcgacccgcggtgccggtgctctccggggtgctgctgtccggcaccgacgaggggctcaccatttccggattcgactacgaggtttccgccgaagcacaggtggcggccgaaatcgcgtctccgggaagtgttttggtatccgggcggttgctgtctgacatcgttcgggcgctgcccaacaagccgatcgacttctacgtcgacggcaatcgggtggcgttgaactgcggaagcgcccggttctcgctgccgacgatggccgtcgaggattacccgacgctgcccacgctgcccgaggagaccgggacgctgccggccgatctgttcgccgaggcgatcgggcaggtcgcgatcgcggccggccgcgacgacaccttgcccatgttgaccggaatccgggtcgagatttccggggacacggtggttttggccgccaccgaccggttccggctggcggttcgcgagctgacctggtcggcggcctcccccgacatcgaagcggcggtcctggtgccggccaagacgctggccgaggcggcgcggaccggcatcgacggttccgacgtgcggctgtcgctgggggcgggcgcgggtgtcggcaaggatggcctgctgggtatcagcggcaacggcaagcgcagcaccacccgcctgctggacgcggaattcccgaagttccgccagctgttgccggctgagcacacggcggtggccaccatcaacgtcgccgagctgaccgaggccatcaagctggtggcgctggtggccgaccggggcgcgcaggtgcggatggaattcagcgaggggtcgctgcggctgtccgccggcgccgacgatgtcggccgggccgaggaggatctggccgtggatttcgccggcgaaccgctgacgatcgcgttcaaccccacgtatctgaccgacggactgggatcggtgcgctccgaacgggtgtcgttcggcttcaccaccccgggcaagcccgcactgctgcgcccggcgtccgacgacgacagcccgccgagcggcagcgggccgttcagcgcgctgcccaccgattacgtctacctgctgatgcccgtgcggttgccaggctaggtgtacgtccggcatttaggactgcgcgacttccggtcctgggcacacgccgacctcgaactgcagccgggtcggacggtcttcatcgggtccaacggcttcgggaagacgaatctgcttgaggcgctgtggtattcgagcacgctggggtcacaccgggtgggcacggacgcgccgttgatccgcgccggcgccgaccgggcggtggtgtcgaccatcgtggtcaacgacggccgggaatgtgcggtcgatctggagatcgccgccggccgggcgaacaaggcgcggctgaaccggtcacccgtgcgcagcacccgcgaggtgctcggcgtgctgcgcgcggtgctgttcgcccccgaggacctggccctggtgcgcggggatccctccgagcggcgccgttacctcgacgacctggcgacgctgcggcgcccggcgatcgccgcggtgcgcgccgactacgacaaggtgttgcggcagcgcaccgcgttgctcaaatcgctgtccggtgcccgccaccggggcgaccgcggcgctctggacaccctcgacgtgtgggacagccggctggccgaatacggggcccaattgatggctgcccgaatcgatttggtgaaccagttggcgccggaggtggagaaggcctatcagctgctggccccgggatcgcgggcggcgtcgatcggctaccgatccagcctgggcgcggcggcctcggccgaggtgaacgccggcgaccgcgactatctggaggccgcgctgctggccgggttggcggcccaccgggacgccgaactggaacggggcatgtgcctggtcggcccgcaccgcgacgacctggagctgtggctcggtgagcaggtggcgaaaggctttgccagccatggggaatcgtggtcgctggcgctgtccctgcggctggccgccttcgagttgctgcgggccgacgaaagcgatccggtgttgctgctcgacgacgtgttcgccgagctcgacgccgcccgccgccgggcactggccgcggtggccgaatccgccgaacaggtgttggtcaccgcggcggtgctcgaagacatcccgacgggctggcaggctcggcggctcttcgtcgagttgcgcgacaccgacgcgggccgggtatcggagctgcgcccatgagcgacgaccagtccccctccccctcgggagaaccgaccgcgatggacctggtgcggcggaccctcgaggaggcccgggccgcggcccgggcacagggaaaagacgccggccgcgggcgcgccgcagcacccacgccgcgccgggtggcgggtcagcggcgcagctggtcgggaccgggacccgacgctcgcgacccgcaaccgctgggccggctggcgcgggacctggccaggaagcggggatggtcggcccaggtcgccgagggcaccgtgttggggaactggacggcggtggtcggtcaccagatcgccgaccacgcggtccccaccggtctgcgcgacggtgtgctgagcgtgtccgccgagtcgacagcctgggccacccagttgcggatgatgcaggcgcaactgttggccaagatcgccgccgcggtcggcaacggggtggtgacctcgctgaagatcaccggcccggccgcgccgtcctggcgcaaaggcccgcggcacatcgccgggcgcgggccgcgcgacacctatgggtaggcccggtcgttagcccggccccatccccaccgcggccttcctcaacagggcgctgaaatccgccaggacgacgcgtatccccttgacgcatgtcgggacgcggcacaaacgaagaaaataagcgcacggcgcggttagctgggtagaaacgcgcccagaaaatcggtgcggaccgctcgtcacggtagactggcaggatgcgattgttgcggtgatcaggaaccgcccgcatgaaaccccaaggagagctttccgaccgtggctgcccagaagaagaaggcgcaagacgaatacggtgcttcagcgatcaccgtcctggaaggactggaggcggtccgcaaacgccccggcatgtacatcggctctaccggcgagcgaggtctgcaccacctcatctgggaggtggtcgacaactcggtcgacgaagcgatggccggctacgccgaccgggtcgacgtgcggatcctggacgacggcagcgttgaggtcgccgacaacggccgcggcatccccgtcgcgatgcacgcgaccggcgcccccaccgtcgacgtggtgatgacgcagctgcacgccggcggcaagttcggcggcgaaaacagcggctacaacgtcagcggcggtctgcacggcgtcggcgtctcggtggtcaacgcactgtccacccggctcgaggtcaacatcgcccgcgacggctacgagtggtcgcagtactacgaccacgccgtgcccggcaccctcaaacagggcgaggccaccaagcgcaccggcaccaccatccggttctgggccgaccccgacatcttcgagaccaccgagtacgacttcgaaacggtggcccgacggctgcaggaaatggcgttcctcaacaagggcctgaccatcaacctcaccgacgagcgggtgaccaacgaagaggtcgtcgacgaggtggtcagcgacaccgccgacgcacccaagtcggcgcaggagaaggcggcggaatcggctgcgccgcataaggtcaagcaccgcaccttccactaccccggcggcctggtcgacttcgtcaaacacatcaatcgcaccaaaaaccccatccaccagagcatcatcgatttcggtgggaagggccccggccacgaggtcgagatcgcgatgcagtggaacggcggctattccgaatcggtgcacacgttcgccaacaccatcaacacgcacgagggcggcacccacgaggagggcttccgcagcgcgttgacctccgtggtcaacaagtacgccaaggacaagaagctgctcaaggacaaggaccccaacctcaccggcgacgacatccgcgagggtttggccgcggtgatctcggtcaaggtgagcgaaccgcagttcgagggccagaccaagaccaaactgggcaacaccgaggtgaagtcgttcgtgcagaaggtgtgcaacgaacagctcacccactggttcgaagccaaccccgcagacgccaaagtcattgtcaacaaggcggtttcgtcagcgcaggcgcgcattgccgcgcgcaaggcgcgagagttggtgcgccgcaagagcgcaaccgacctgggcgggctgcccggcaagctcgccgactgccggtcgaccgatccgcgcaagtcggaattgtatgtggtcgagggtgactcggccggcggctcggcgaaaagcggccgggactcgatgttccaggccatccttccgctgcgcggcaagatcatcaacgtcgaaaaggcccgcatcgaccgggttttgaagaacaccgaagtgcaggcgatcatcaccgcgctgggcaccgggattcacgacgagttcgacatcaccaagctgcgctaccacaagatcgtgttgatggccgacgccgacgtggacggccagcacatctcgacgctgttgttgacgctgctgttccggttcatgcggccgctgatcgaacacgggcacgtgttcttggcccagccaccgctgtacaagctgaaatggcagcgcagcgatccagagttcgcctactccgaccgcgagcgggacgggctgctcgaggccggcctgaaggccggcaagaagatcaacaaggacgacggtatccagcgctacaagggtctgggcgagatggacgccaaggaattgtgggaaaccacaatggatcccaccgtgcgggtgctgcgccaggtcacgctggacgacgccgcggccgccgacgagctgttctccatcctgatgggcgaggacgtcgacgcgcgccgcagcttcatcacccgcaatgccaaagacgttcgcttcctagacgtttaaacgaggaatagatgactgacaccacgctgccacccggcggtgacgccgccgaccgcgtcgaaccggtcgacatccagcaggagatgcagcgcagctacatcgattacgcgatgagcgtaatcgtcggccgcgcgctgcccgaggtgcgcgacggcctcaagccggtgcaccgccgggtactttacgccatgtacgactcgggtttccgcccggaccgcagccacgccaagtcggcgcggtcggtcgccgagacgatgggcaactaccacccgcacggcgacgcctcgatctacgacaccctggtgcggatggcccagccgtggtcgctgcgctacccgttggtcgacgggcagggcaactttggttcgccgggcaacgacccgccggccgcgatgcggtacaccgaggcgcggctgaccccgctggccatggagatgctgcgcgaaatcgacgaggagacagtcgatttcattcccaactacgacggccgggtgcaagagccgacggtgctgcccagccggttccccaacctgctggccaacgggtcggggggcatcgcggtcggcatggccacgaacatcccgccgcacaacctcggcgagctcgccgaggcggtgttctgggcgctggacaattacgaggccgacgaagaggccaccctggccgccgtgatggaacgggtgaaaggacccgacttcccgacctccggcctgatcgtcggcacgcagggcatcgccgacgcctacaagaccggccgcggttccatccggatgcgcggagtcgttgaggtggaagaggattcgcgcggccgcacctcgctggtcatcaccgagttgccgtatcaggtcaaccacgacaacttcatcacctcgatcgccgagcaggtgcgcgacggcaagctggccggcatctccaatatcgaggaccaatccagcgaccgggtcgggctgcgcatcgtcatcgagctcaagcgcgacgccgtcgccaaggtggtgctgaacaacctctacaagcacacccagctgcagaccagcttcggcgccaacatgctggccatcgtcgacggggtgccgcgcaccctgcggctcgaccagctgatccgccactacgtcgaccaccaactcgacgtcatcgtccggcgcaccacctaccggttgcgcaaggccaacgagcgggcccacatcctgcgcggtctggtcaaggcgctcgatgcgctcgacgaggtcatcgccctgatccgggcgtcggaaaccgtcgacatcgcgcggcagggcttgatcgagctgctcgacatcgacgagatccaggcgcaggcgatcctggacatgcagctgcgccggctggccgcgctggagcggcagcgcatcatcgacgacctggccaagatcgaggccgagatcgccgacctggaggacatcctggccaagccggaacggcagcgcggcatcgtgcgcgacgagctcgccgagatcgtcgaaaagcacggcgacgcgcggcgcacccggatcgtggccgccgacggcgacgttagcgacgaggatctgatcgctcgcgaggacgtcgtcgtcaccatcaccgagaccggctacgccaagcgcaccaagaccgacctgtaccgcagccagaagcgcggcggcaagggcgtgcagggcgccggcctcaaccaggacgacatcgtgcggcacttcttcgtgtgctcgacgcacgactggatcctgttcttcaccacccagggccgggtctaccgcgccaaggcctacgaactgcccgaggcgtcccgcaccgcccgcggtcagcacgtggccaacctgctggcgttccagcccgaggagcggatcgctcaggtgatccagatccggagctatgaggacgctccctacctggtgctggccacccgcaacggcctggtgaagaagaccaagctgaccgacttcgactcgaaccgctcgggcggcatcgtggcgatcaacctgcgcgacaacgacgaactcgtgggcgcggtgttgtgctcggccgaggacgatctgctgctggtgtcggccaacggccagtccatccggttctcggcgaccgacgaggcgctgcgcccgatgggccgcgccacctccggtgtgcagggcatgcgcttcaacgccgacgactacctgctgtcgctcaacgtggtccgcgagggcacctacctgctggtggcgacgtccggcgggtacgccaagcgcaccgcgatcgaggagtatccggtgcagggccgcggcggcaagggcgtgctgaccgtgatgtatgaccgccgccgtggcaggctggtgggtgcgctgattgtggacgaggacagcgagctgtacgcgatcacctccggcggcggtgtcatccgcaccgcggcgggccaggtccgtaaggcgggacggcagaccaagggcgtccggctgatgaatctgggtgagggcgacacgctgctggccatcgctcgcaacgccgaggaagccgcggacgaggccgtcgacgagagcgacggtgccgcggggtcggacggctagccggtaccgcgccaccgggtccgggcaatagactcagccggaccacacataacgcgactgccactgccctgggcggccggctaggagacttaaggagtcggggtgagttcaccgaacgagccgggcgcacccaagaagggggagacccccaacggggacggttcggcagagcgggccggggtgcggcgggcgacaccgccggcgccgggtggccgcgcccccgaggccggcgacggaccgccgtggcagcgcggcagcacccggccccagcagcccccgccgcgccagaacgagccgcccaccgagaagcgggccgacggcggcggggccgaggcccggctgaaccgcttcatctcgggcaccgcgtcgcacgccaaggagccggagcgcggtgaggggccccccgccgaggcctacgccagcgaactgcccgacctgtcggggccggtgccgcgcggcccacaccgcaagccggccgccgagcgcggtgccgagacgaccggcgggcaaggcggtggccgtccggtgagcggcgagagccgcgagggccgggacaaccgggaccgggtgcaggtgtcgcggcgcacccgcgggccggttcgcgccagcatgcagatccgccggatcgacccgtggagcaccctgaaggtgtcgctgctgctctcggtggcgctattcttcgtctggatgatcgccgtcgcgttcctctacctggtgctcggtggcatgggcgtgtggtcgaagttgaacagcaacgtcggggacctgctgaacaacaccagcggcagcagcggcgaattggtgtccagcggcaccattttcggcggcgccgtgctgatcggcctggtcaacatcgtgctgttgaccgcgatggcgaccatcgcggcgttcatctacaacctggccaccgatctgatcggcggcatcgaggtcaccctggccgatcgcgactagcgtggatgctgtgcttttgggagtcgggcggccggtgcggtaatctcgtcgctcggccgtacgccagtacgggcctatagctcaggcggttagagcgcttcgctgataacgaagaggtcggaggttcgagtcctcctaggcccaccaccatgtgcccgtcacgacgctgcgtacgactcgcgctgccactgggattgttcgccgtgttggcggcggtggcgtggtcacggcgcggggtggaggtctggcacgtggccgtgcaggattccggtcagcccctgggccacaatgaggggtcacggtagcggggccttagctcagttggtagagcaccgcctttgcaaggcgggtgtcaggggttcgattcccctaggctccacaaatcgaatccctctccccgcccgggcggtacgacgcgccgaggaagcggtgcaccagggcgcgctcggcggccgggtccttgagcggccagccccataacgccaggaagacgcggatcagccactgcgccgccagcgggtcgtcgtggccgggcccgagcatctcggcggccagggccgtcaccgtgggcgagttgatcacccagtcgctgaccggggccgcgtggatcgaccgcatcagctgagccagcggatcggagcgcaaccgttccagcgccatgatcgtggcggtcaccacccgctcggggccgcgcaggtctttgatggcctcccgcgtggtgtcgacgatgcgggcggcctggataccgacgacggcatcgcggatcgtcgccttgccgccggcgtgccggtagatggtcgccggtgaacagtgcacccgggccgccagcgcctcgatcgtgaacccgtcgtagccgcggcgcgcgatgaggtcggcggccgcggcgtagatccgctcggcggccgcgctgcgccgatcccggcccaccaaccagtcgtcccgcgccatccacccatgctccaccacgctgcacgacgcgcaaagcgctttcgcagcgtgagaattttgtgacgaaatctctcaccggaaccgcctgctcgcgacgggtcacccgcacccgcaggcgccgtccccggccgtcgtcgctcctcaacttcgccgcggcccgttgacgccgcgagacggcgcgtcgagcctgaaacgcatggcggtgttggacagcgcgacccggttcttcggcagcgaggcgatacaggatccctacccgctgtatgagcgcatgcacgccgaggcgccgatgcaccggatcggcgactccgtcttctacgccgtgtgcgggtgggacgcggtgcacgaggccatcgagcgggtcgaggacttctcgtccaacctcaccgcgacgatggtcttccacgaggacggcaccgtcaccccgttcgacatgggcgcgccgggcgccccgatgcacgcgctggccaccgccgacgaccccgtgcacgcggtgcaccgcaagatcctgctgccgcacctttcggcgaagcgaatccggatcatcgaggagttcgccacccagaccgccgaccggctgtgggacgagaacctgtccgacggccggatcgagtggatgagcgccatcgccaaccggttgcccatgatggtggtctgccggctgctgggtctgcccgatgacgatgtcgacaaactcatccggctcggctacgccaccaccacactgctggacgggatcgtcgcccccgaacagctcgagcaggccggcatggccgccatcgaactgtccggctacgtgctggagcatttcgaaaaggcaagcgagaagccggaatccagcctgatggccgatcttgcggcgcgctgcgccgccggcgaactcgagcagctgccggcgctgggaatcatgctcacgctgttcagcgcggccggcgaatcgaccgcgtcgctgctgggcagcgcggcctggatcctggccgaccggccggcgatccaacggcagcttcgcgaaaacccggagttgctaagcactttcatcgaagagacgctgcgcttcgaggcgccgtttcggggtcactaccgccacgtgtggcgcgacaccacgctgggcgggatcgagctgcccgagggcgcacacctgctgctgatgtggggagcggccaaccgcgacccgacacatttcaaggatcccaacgagtttcggctcgaccgcgcggccgccaagagccacctgagcttcggcaagggcgtccacttctgcgtcggtgccgcgctggcccggctggaagcccacatcgtgttgcgccggctgctcgagcgcaccagctggatcgacgcgaccgacgtcggggattggctgcccagcatcctggtccggcgccgggaacggctggggttggccgtgcgctgagctacggccgcggttgcacgtcgacgctcggcggccgcgactgcggctcctgcggcttctcgcgcaccgagcgccgcacgatgctgaacgcggcggcgcccccggcgagaacggcgacggcgacaccggcgatgacccacgggcgcttgccccgtcgctgcgcgcgccgcgcgtcctgcagcgcctggggcaggccggtgaccacctcctgagcggcggccagttcctgggcgagggtctcctgggccgcggcgaggtctcgggccaggcgcccctcccggtaccggcgccgcagctgctcggccgtcgaccgcgcggactgcacgctcaggccggcgactccccgggtgaggtccagcggtcccagtgtcgagtaggtcaggccgcgggccagtcgctctcgcggggtcagccggtcttccgccttagcgcgcatcggtcgcctttctgtcgagcccgcagttcaccgaacagactgccagcatagggacatcggcggagccgcgtgcgggcacgccggggcctagtggcagactctgatgccgtgactaacagcccctttcagactgctaccgccacgctgcacaccaaccgcggtgacatcaaggtcgccctgttcggaaaccacgcgcccaagaccgtggccaacttcgtcggcctggcccagggcaccaaggagtactcgacccagaacgcgtcgggcggctcctcgggcccgttctacgacggcgcggtgttccaccgggtgatccggggcttcatgatccagggcggcgacccgaccggcaccggccgcggcggtccggggtacaagttcgccgacgagttccaccccgagctgcagttcgaccggccgtacctgctggcgatggccaacgcggggccgggcaccaacggctcgcagttcctcatcaccgtggacaagaccccgcacctgaaccggcggcacaccatcttcggcgaggtcgtcgacccggagtcgcagaaggtcgtcgacgcgatctcgacgaccagcaccgacggcaacgaccgcccgtccgagccggtggtgatcgagtcgatcaccatctcgtagcacgcggcctctcagcgctgtcgcgggcccgcgtaaccggcggcggtgagcgcgtcgagcacctggagcgggtccgccccgagatcccagcgggacagcaccaccaggtctccgtcggcgctttccacctcgagcaaccgcaccttgcgcccgtagcggcggaactcgatgatccggatgatcttgatgtcggggcgttgtaatacctgcgtccgataccagccgcggacggccagcccgtcgggtgtgattgccagcttcgggcgcgcgcgccacgacatccccgcaaacacgagcagacccgccgcggcaacgccagccagaacacgccccggcgggtctgtgaccacggtcacagccgcgatagccatcagaacgcccgcaactccacaaccagcgattcccgccggatgcggctcccaccgtgtttgctgcatgcgctgcttagcccctcccaccacggccgatgcagttatccacaatctcttatcaacagtggggataaatcacacgcgtgtgattgggtggtcgggaagttgctggcgcgggtgcgaatcatcccgaaaatgaattcatttcgtacgcgggcccgctcagtgccagcgcatcgtgagcaacaaaccggtgatcatgaaagcgaacgcgattgcgtagttccacggccccaattgggccatccaattgagggcggtcggcgcctggctgcccaccgcggccagttggaagaccatcagccacaccaatccgatcagcatcagcccgatgaacagcgcgacgaaccacacgctggacggtcccaccttgaccttcaccggcgtgcggctgaccgcgctgacggtgaagtcgttctttttgcggaccttggacttgggcatgattacctcgcggattacctcaacaacacggtgagcgggacggagtgcgacgatgaacatcgcagccgcacccagagcttggctacgagactaacgcaccggccgcggtggccaggaaaacggagagtcgatggtccagacgcgccagtcgccatggcgcttcggcgtcccgctggtctgcctgctggccggattgctgctcgccgccacgcacggcgtgtccggcggcgccgagatacgccgcagcgacgcaccccggctggtggacctggtgcgcgagacgcaggcgtcggtgaaccggctcagtgcccagcgcgaacagctcgccgccaagatcgacgccgcgcacggccgctcgtcggatgccgcgctggccgcgatgctgcgccgctccgcgcagctcgccggcgaggccgggatgagcccggtgcacgggccgggcctggtggtcaccctgcaggatgcgcagcgcgacgccaacggccgcttcccccgcgacgcgtcgcccgacgacctggtggtgcaccagcaggacatccaggccgtgctcaacgcactgtggagcgccggcgccgaggcgatccagatgcaggaccagcggatcatcgccacgtcggtgccccgctgcgtcggcaacacgctgctgctcaacgggcgcacctacagcccgccctacacgatcaccgcgatcggcaacgccgccgccatgcaggccgccctggccgcggctcccctggtgacgctgtacaagcagtacgcggtccggttcggcctgggctatcaggaagaggtccgctccgatgtgcaggtggtcggccacttcgagcccgaccggctgcatttcgcccagcccaacggcccgatcggctactaacgccgactgacctgcggcgcgagcgtccgcgggcggtaacctggcacgatgcggatcctggttgtcgacaactacgacagcttcgtgttcaacctggtgcagtacctcgggcaactgggtgtggacgccgacgtctggcgcaacgacgacagccggctcgccgaccacaacgccgaggcccgccggttcgacggggtgctgctcagtcccgggccgggcacccccgagcgcgcgggcgcttccatcgcgatggtgcgcgcctgcgccgccgagcacaccccgctgctgggggtctgcctgggccaccaggccatcggcgtggcattcggcgccaccgtggaccgcgctccggaactgctgcacggcaagaccagcagcgtgcgccacacgaatgccggtgtgctgcaagggcttccggaccccttcacggccacccggtaccactcgctgaccatcctgcccgagtcgctgccgccggtgctcgaggtcaccgctcacaccgacagcggtgtgatcatgggcgtgcgccacacgcagttaccgatccacggcgtccagttccacccggagtcgatcctgaccgagggtggtcatcgcatgctggcgaactggctcaccgaatgcggctgggtgcgcgacgacaccctggtgcgccggctggaaaacgacgtccacgccgcggtgcgaccgtatctcccggccgatccggccgctactgaccgaacttcagcgtgatgatcccgtcccggttgaccccggccccggccggcgggttctgatacaccacccggtgggactgggcgccgccggcgtcgacgtcgggacccttgtccaggatccccgtccagcccagcgcccgtagccgcggttcggcgtcggtccaaaacatcccggacaggtcgggcatgatgaactgattgcccttggacacctgcagttcgatcaccgaatccaccggaaccgtttgtcccttgggcggattggtgccgatcacctcgccggccgggcgggggctgtccacctgcacctgggtgatcttggtgaagccgtagacggtcaggttcttctgcgcgatgtcgacggtttgcccggcgatgtcgggcacctgcttggtctccggccccgagccgacgatgagggtgatgacgttggtgatcgccgacgtctggttggccggcgggttggtcccgatcaccttgcccaacaactcgggtgtggacggcgagttcgcctgcttgaacttgctgaacccggcggccttgagcttggtgaccgcgtcggagtagctcagcgacgagacgtcgggcacctcgcgctgctccggcccggtggagacgttgatggtgatctcgtcgcccgcgctgaccgacgcgttggcgccggggtcggtgccgatgacgtggtcgggcgggatggccgagtccggcttctgcagggtgcgggtcttgaagccgcggttctgcagcgccgcaatggcatcggcggacacctgcccgcgcacgtcgggcacctggacgtcgcgggcgccgccgccgaaggtgttgaacgcgatgacgacgatgatggtcaggaccgccagcgcggccaccgccacgatccaacggcccaccgaacccaccgtgcggtcctcgccgctgtccgcgagcacctggcgaggcagcggatcggtgcgtgacggacccgcggccccggcaccggacgacaacagcgagctgcgctcggcgtcggtgagaacctttggcgcttccggcttttcgccgttgtgcacccggaccagatcggcgcgcatttcgaccgcggtctgatagcggttgtccgggtttttggccagcgccttgagcacgacggcgtcgaggtcggcggagatgccttcgtgccgctgcgacggcggcaccgggtcttcgcggacatgctggtaggccaccgccaccggcgagtcgccggtgaaaggcggctcgccagtgaggatttcgtacagcacgcagcccagcgagtagacgtccgagcgcgcgtcgacggcgtcgccgcgggcctgctcgggcgagaggtactgtgcggttccgatcaccgccgcggtctgggtgacgctgttgccgctgtcggcgattgcgcgggcgatgccgaagtccatcaccttgacggcattggtggtgctgatcatgatgttcgccggcttgacgtcgcggtggatgatgccgttctggtggctgaagttcagcgcctggcaggcgtcggcgatgatctcgatggcccgccgcggcggcagcggcccgtcggtgtgcacgatgtcgcgcagcgtcacgccgtcgacgtactccatgacgatgtagggcagcggcccggagggcgtctccgcctcgccggtgtcgtagacggcgacgatggacgggtggttgagcgcggcggcgttttgcgcctcgcgccggaagcgcaggtagaaactgggatcgcgggccaggtccgcgcgcagcaccttgaccgcgacgtcgcggtgcagccggacgtcacgggccaggtgaacctcggacatgccgccgaagccgaggatctcgccgagttcgtagcggtcggacaggtgttgcggggtggtcattgcgatgtccagtgtcgggcgggtccgtcgcggaatccagacgccccaattgtgccgtcatccggccagtccagccgcaggcccgggtgggccccggagccgctcggcgtcttggtcggcggcggcgccgaggcgggcggggttccggtgtcggtgaccgtcgggggctgttgctgctggtccgcgcgggagttgatgacgatgagcaccgcgatgatgatcgccagcgcgcccagcaccccggcggcccacagcagcgcccgctggccggacgagaaggtgcgccgggccgggggcgggcggtggccgccggtggccggccgggtccgccgcggcgcggcggtccgcccggaggacacggctgccgcccgggtggtggggctggacggaatggccgccggtgacgcccgcccgggcggcggggactggctcggccgcggcggccggcgaccggcgcgcaccgcggcgacggcgtcggcgaacggccccccgctgcggtagcgcatcgccgggttcttcacagggtgatctcgatgagctcgcgcacgttgggtggcagctccgcgggcagcggcggcggaggctccttgatgtgtttcatcgccaccgtcagcgccccatccccgctgaacggccgcttgcccgaaaccacctcgtagccaacaactcccagcgagtacacgtcgctggcgggggtggcgtcgtgacccagcgcctgctcgggcgcgatgtattgggcggtgcccatcaccattccggtctgggtcaccggcgcggcgtcgacggccttggcgataccgaagtcggtgatcttcacctgccccgtcggggtgatcaggatgttgcccggtttgacgtcgcggtgcaccaggccggcggcgtgcgcgacctgcagggcgcggccggtctgctcgagcatgtccagcgcgtgccgcagcgacagccggccggtccgcttgagcaccgagttcagcggctcaccgttgaccagttccatcaccagatacgcggtgcggccctcgccgtccagctggctctcgccgtagtcgtgcacagccgcgatgcccgggtggttgagcatcgccgtggtgcgcgcctcggcgcggaaccgctcgatgaactcggggtcctgggagaactcctgtttgagcaccttgaccgcgacgcgccggcccagccggttgtcgaccgcctcccagacctgacccatgccgccggtggcgatcaggcgctgcaggcggtacctgccagacagcgtcacaccaactcgcgggctcatggtcctccctgtagcgcggcctcgatcacagcccgtccgatcggcgcggcgagtgcaccccccgtcgcggacaggcggtcggcgccattctccaccaacaccgccacggcgacctttggggtctgtgcgggcgcgaaagcgatgtaccacgcatgcggcggtgtgtgccgcggatcgctgccatgctctgcggtacccgtcttggatgcgatctgcacgccgggaatggcccctttctgctgtgcgaccttctcggcgccgaccatcagctctgttagcttagcggcgacctgcggcgacaccgcgcgccgctgctcataaggggtggtggtgctgatcgtggtcaggtcggggcccttgaggctgtcgaccagatagggctgcatggtcaccccgccgttggcgatggtcgcggcgatctcggcgttctgcaacggggtcagcgcgacatccttctgaccgatgctcgacatgcccagcgccgcggcgtccgggatgatgccgatggtcgattcggccacctgcagcgggatgacgctgggcgtgctgtccaggccgaacgagcgcgccatgctgcgcaacgcgtccgcgccggtgaggatgccgagctggacgaacgcggtgttgcaggacagggcgaaggcctgctgcaacgacacggtcgggtcgttgccgcacgcctgcccaccgtagttctccagcgtcgcggtgctgttgggcagcggtattgacggcgcggcggtcagctgctcggtgtcgctggcgccggcctgcagcgcggccgccgtggtgatcaccttgaacgtcgagccgggcgggtaggtctcggagatggcccggttggtcatcgggttgtcgggatcgtcgcgcagccgctgccacgcctgcgcctgcacctcggggtcgtgcgaggacagcaggttggggtcgtaggacggcgacgacaccatggccaggatcttgccggtggacggctcgagggcgaccaccgcgcccttgcacggcgggccgccgcagccctgctgcatgccgtcccaggccgcctgctggacccgcggcctgatggtggtgtcgacgttggcgccgcgcgggtcgcggccggtgaagaagtcggccagccggcgcccgaacagccgctcgtcggagccgttcagcagcgggtcctcggcgcgttccagcccggtgctcgagtagcgcagcgagtagaacccggtcaccggcgcgtactgggcggggttggggtagacccgcaggaagcggaaccggttgtcggtggcgaccgaataggccagcagctggccgccggccacgatctggccgcgctggcgggagtactcgtcgagcagcacccgctggttgcgcgggtcggcgcgcagcgagtcggccgcgaagacctgcgtcatcgtggcgttgagcagcagcagcacgatcaacgccatcacggtcaccgagatccggcgcagggaggcgttcatactttctcgatcacctcggtgctggccgccgcgatcgacggctcggtgcgggcgcgggtgcgcaacggacggcgggcgctgtgcgagatacgcgccaggatggccagcagcacgtagttcgccaggagcgacgaacccccgtacgacatccacggggtggtcagcccggtcagcgggatgagctgcgtgaccccgccgacgacgatgaacagctggatggccagcgtggacgccaggccggcggccagcagcttgccgaagctgtcccgggtggcgatcgcggtgcgcagaccgcgcacgatgacgatggtgtagagcatcaagatggcggccagccccaccagccccagctcttcaccgaaggcggcgatgatgaagtcggtcgacgcggcgggcacggtgtcgggctgaccgttgcccagcccggtgccgaagatcccgccggtggcgaagctgaacagcgactgcacgatctggtagccgctgccgtcggggtcggagaacgggtcccaccacatctgcacccgcacccggacgtgcgcgaaaatgtaatacgcgacaacgcttcccgcgacgaagagcaccaagccgatggccacccagctgaaccgctgagtcgccagatacaccaccaccagaaacgacgtgtagagcaaaagcgaagtgccaaggtctttttcgaaggccataaccccgaccgagatcacccaggccgccagcagcggggcgaggtcgcgcggacgcggcagcgtcaaacccatgaaatgcttgccgacgctggtgaacaggccccgcttggcgatcagcaccgcggagaagaagatcagcagcaagatcttggagaactcggcgggctgaatcgagaaccccgggaagcgaatccagatcttggcgccgttctgttcggacagcgaggccggcaacagagcgggaatcaccaggaataccaggccgaccagtccacagatgtagccgtagcgggcgagctgtcgatggtctttgaggaaggtgaccaccagggcgaaggtgaccacgccaatcagggtccacagcatctgctgagtggcgctcgggtggtgacggccgctgagctgactggtcaccagatccagccgatgaatcatgaccagcccaagtccgttgagcaaggccacaattggcaacagcagggggtcggtgtagggcgcaaatcgccggatggccatgtgcgcggatccgaagacgaccaagaacaccagtccgtagctgaccgcgttccagcgcagatcgtgttgttggttggcttcaacgatcagcagcgcggccacggtgatggtggcggcgaagcccagcagcaacaactcggcgttgcgccgggtgggcagcgggggcgtgaccgcgaccggcggctgaagttgtgtggtcatgccaccgtccggcagtcgatgcccggttgaagagggggcccgggaagcgcggtcaacgtctgcgacgtggtggtcgggcctgccggcgaagagctcgccgggccgggggtggcgttggtgctgggagtggggctggcgctggtggtcggtggtgcgggcgacgcggggccgccggtttcgggtacagggctgcgggtggcctgtgccccgggcggtgaggtggcgcgcggcggcggacagagcggcagcaggtattcggccagcagttgacgcagctgcgattcggcctggtccaggctgccgccgggcagcccggtttgcacctggacctgcccggggcggcgcaggtcttgcagcgtcatcagctggcagttggagccgccggactgcccgtagctgatcagcgacagttcgttacgcgcgttgaggcagcccaccagatagggctgctgcaggggcacccccagcaggctgccctgaatcccgcggacgatggagatccggccgttgtattcggcgacgtagtagttgcgctggatgacccaccaccccacggtgaggccggccaacaccagcatcaccgccagggcgatgacgacgaacagccgtcgccgcgaccaccgcggccggctgggtgtttccggttgcggcgcaacgcgtttcgcggactcgtcgcgcggccggatcgccgaggcgcgtcccgcggaggtgttgggcagggtcagctggtcctcgtcgccggacaccgcgccggccaggatcggctgggtttggccgtagtcgtagtcgaccacgtcggctaccacgacggtgacgttgtccgggccgccgccgcgcaacgccaactcgatgaggcggtaggcggcctcggccacgtccgggatctgcagggcctcgaggatggtctcgtcgctgaccgggtcggacaacccgtccgagcacagcaggtagcggtcgccggcgcgggcttcgcgcatggtcagcgtcggctcgacctcgtgaccggtgagcgcgcgcatgatcaacgagcgctgcgggtggctgtgcgcctcctcccgggtgatgcggccctcgtcgaccagcgtctggacgaacgtgtcgtccttggtgatctgggtgagctcgccgtcgcgcagcaggtagccgcgggagtcgccgatgtgcaccagcccgatgcggtcgccggcgaacaggatcgcggtgagggtggtgcccatcccctccagctcgggctccgcttccacctgcgcggcgatcgcggcgttgccggcgcgcaccgcctcgtcgagcttggccagcaggtcgccgccgggctcgtcgtcgtcgaggtgcgccagggcggcgatcaccagctgggacgccacctcgccggcggcgtggccgcccatgccgtcggccagtgcgagcagccgggcgccggcatagacggagtcttcgttgttggagcgcaccaggccgcgatcactgcgcgcggcataccgcaggaccagggtcacgggcgttgctccttgatcccggcgggcgaacccgccgagccggtgtcatcgccgtaggcgcgggtcatgggcgcaactcgatcgccgttttgccgattcgaatcggcgttccgatcggaactcgtaccgcagtggtcacctttgccctgtcgaggtaagtgccgttggtcgatcctagatcctcgacgtaccactccgagccgcgctgagtcagccgggcgtgccgcgccgaggcgtagtcgtcggtgagcaccagggtcgagtcgtcagcacgcccgatcaacaccggctgcccgctgagggtgatgcgcccgccggccagcgcgccctcggtcaccaccagatagcgggcggcgtggcggcgctgacgggacggcagcagggtgctgcgcagcgccaggccgcgacgcaccatgacggcaccggtgggcgcatagatgtcggtccgcaggattcgcagcacggaccagatgaatacccatagcaacattaaaaatccggcgcgcgtcagctgcagtaccagtccctgcatctggcgtcctttccgtcctagcgtcgtgtctccggcgcccgtgactccgagcacatcggctacgtcacgatacttggacggtgatcgacacggggcgaagcacggcagcggtgagcccagtggcctagtggatccggacgatgatctccgagtggcccaaccggatgacgtccccgtcggccaactgccactcctggacgggtgcgttgttcaccgtggtgccgttggtggagttcaggtccgacagcagcgccacctgtccatcccagcggatctccaggtgccggcgtgagacgccggtgtcgggcaaccggaactgcgcatcttggccacggccgatgatgttggaaccctcgcgcagctggtaggtgcggccgctgccgtcgtcgagttgcagggtgaccgtggtgccggtggacccgtagccgccctggccgtaaccgccgtagccgccggcctgttgcccgtagtcggcgggctgaccgtactcggccggctgggcgtactccggctgctggccgtagtcggcgggttggccgtactcgtactcggagccgggcgcctcggggtagccgccgcccggtggggcgtaggtagcgccctgggcgtgctcggcgtactgcgtgtactcggcggacccgtagtcctggcggccgtatcccccgccctgcgggtagccctggtcgtagccgccgccctgctccgggtaggcgggccgctgctcgggcggggcgtagccgccctcgtccgggcgggccgggccgcgaccgtagtcgccgtaaccgccgtagccctgcgggccgccggcgggctggccgccgggcggggggtagccgccgggtgggcggtagccctggtcgtagccctggccgctgtatcccggcggcgcgggcggacgctgttcgtaggactgcgggtagccgccctgcgccggctcggggtagccgcgctggtcgggatagccgtgctgctggggcgggtagccgccctggcccggctcggggtagccgccgcgctggtcggggtatccgccgtgctcctggtagctctgcggcggcgggtagccgccttgctcggggtagccgccctgctcggggtggcggggcggcgggtagccctgctggggtgggtagccggcctgttcaggcgggtagccgccgcgctggtccggcgcaccctgcggctccgagccaccgcgcgcgtcgtcctggggacgcccgtagcgctcgtcgtagtactcgtcgccgggccgtcccggcccctgagccccgcggtagctcgaattgtcagtcattggtgctactcctcgttcttcgccgaacgcgttatttgattgtggccggacggggtcgtcgaccgtcgggcggggctggacatcagggttgacagcaccacaggcgcggtactggccggtgcgcaggctcgacgactgctcgaaccgaacgaccacctcaccatacgtttgccacccctgttcgtggatgtagtcagccaagtacctcgcgaaagcgctcgacgtgagatccggatcggcgctgaccttctcgaagtcgtgcataccgagggtaatgatgtattcgttgggggccaaaaggcgatttccgtgcagcttctggacgccgtcgcgggcctcgcggcacaacagggcctcgacctcttgcgggacgatgggcccgccgaacacgcgggcgaaagcgttgtcgaccgtcgcctcgagtttgcgctcgatccgcgcaaccagcccccgttggctactcatgttctaccgttcgcccgcacttgccctcaggtattgccggtgcgcggcaaacgaatcacccgggtgctggttcactcccgcatggtatcgggacagcacgacgccgcggcacttccgaaatcgtgagaaccgcatccacgcagttcaggggcgtgcccgcggggttgggcataatggacggcgggccacggccccactgcggcgattcgggaatcgggccattacagtggtatggtccatcggttgtttttccgggcgagtggcggaatggcagacgcgctggcttcaggtgccagtgtccttcgggacgtgggggttcaagtcccccttcgcccacactgagcggttcgacgaaaggtcacggcctcgaaagaggtcgtgaccttcgtgctttccggggatcggcggcgcgggcgtgcgcgcggcctaccgtcatagttggcgacggatgtcgagcaggtggtgctgggcttcgtgtgcggtgtgcaccgcgacccagcgcagcgaccgctcggcggtcaccgggtagtggtagacgacggtgcggtcccagtccgccgtcgtcaaccgggccagcacattgccgaacagcaatgcggcgtcggcgagttggcgagccacggtgccgggttcctgctcgttgtatccgtcatgaacggcgcggtcctcgcggcccatcgagacgcagtcggccccattcgtccgccgcgccgcgagcacccgctcgcgctgcaccagcaatacgtcccgcaggtggcaaccgtattcgagcggcgaccagacaccatcacgtggccgagagcgaacgtcaattgtgttgtcgcacaagatcgtgacgacctcggccactcgcgcgcggacgtcatcgccggcggttgcggcctgccgcaggtcataggcgaaaccgcattcccggcacggatcggtcaccagcacatgatggcagaccgggtcgccgggcgtccgagcgccgtgagcagccgaccgcttccgaagtggttggcgccgtgggcaagtcacgccggtctgggcaggtcttggtcttggccttggcgacggccggcgcgccgagtcgtggttggcagtgacacacaccacccgtgtgctgaggctagccgtacctaaatcgtgtgggtatggtccgggtaatgacctcctccaatccaccactgccccgcgccgtcgatgatcggttggtcagcatccttcgcgacgacctggacctcaagttcgaatcactcagtcccacaacgcgtctgatcgacgacctgggaatggactcggtcgcgttcgccgtcagcctggtcgccatcgaagaacgcttcggtacgcagttgagcgaggaagacctgctgtattgcacgaccgtcggcgacctgcagtccgcgatcgccgccagggtcaacgcatgaacgccctcgccgccgcgatgcgcgacgcgatgacacgatcaccgcacgacctggtggtcctggacaaagactccgacacatggcggtcctgcccctggcccgaggtacacggcatggccgaaagcatcgccgcgcgtctgcttcagcgggaccggctgggagccgtgggcctggtcggtgagccgaccgtcgaactgatcgccgccattcagggtgcgtggttggccggcgtcgcggtgtcccttctcccccggccgcggcggggcgccgacccgtcggaatgggcgcacagcaccctgcagcgcttcggcgggatcggcgtcgacacggtgctgagtcatggcggtgtgctgcgcaccttggccgccgccgactccgccgtttccgtttgcgacctggcccaggcggctcgcaccccgacgtcgaccggccttgagtaccaagatgattcgggcgttgcgatcctgcagggcacggcgggctcgacggggaacccgcgcacggcggtgctgtcgccggccgcggtgttgagcaatatgcgcggcctcatcgagcgcctgcggctcgacggtgcttcggatcgggcatgttcgtggctgccgctctaccacgacatggggttggcgttcctgctcacctccgcgctcagcggcatgccactctggcaggcgccgacgggcgccttctcggcggcgccgctgcgctgggcggagtggctgtccgacagccaggcaacgttcaccgccggccccaatttcggctactcgatgatcggtcgctactcggggagggtgcgcgacgttgacctcggggcgctgcggattgcgatcaacgggggcgaaccggtggattgcgaggggttccagcggttcgcaacggcgatggcgccgttcggctttcgggcagcggccgccactccggcctacgggatggccgaggcgacgtgtgcggtgacgatgcccggctgcggagagggattgcagatcgacgagcgaacggaatccggtgtccgccaacggtatgccctgctgggcggacccatcgccgggatggagctacgcatagctgcgaccgacgagccgtccggcgagggcgtcggggaggtcgagatccgcggatcgtcgacgatgaccggctatttgggcgacacgacgggccgatccgacggtgattggttcccgaccggggacatcggctatctggtcgacggcgcgctggtcatctgcggtcggtccaaagaggtcatcaccgttgccggccgcaacatctttcccaccgagatcgaacaggtggccgcgcaagtggacggcgtgcggcacggcggcgtggtcgcggtgggatccaaatccggtgcggcacaatcccgattgctgatcgcggccgagttcgtcggagcggaccgtgatgtgacgcgcagcgccgtcatcaagcgggtcatctcggtctgcggggtgacaccggcggacgtcgtgctgatgccgccggggtcgctgccgcgcacgtcgtcgggcaaactcaggcgactcgaggtgcgccgccaactgctgggctgagcggacggttttcggccgacctggcggttgttcggctgtagtgaattgaccggtgcgcccgcgccagtaccctcatgagcagtttgggagggttgcagatgcgcgtcagcacgcggcgccggtgtggcgatgagcgctcggccgcgaaggtgccatgggactcccgtacatagataagcaggcgctgatcgccgaagcaggcggtgacccgtgggcgatcaatgcgagcctgcaggcgggcagcccatcacagatctccaacctggccggggcctttcaccgcgcgggccgctgcacgcaggaagccgataacgcgttccagcaagcccggtcacgattcgacgcggcctggaatcaccaggacggcgatcatcccatcaacgactccgaggaagtgcaacgcgtcacgaaagcccttggggcccagtccttgcagctgcccaagatcggcgccgacctggaaggcattgccgccgcgctggccgaggcgcagaaagcgggtgcggcgcggatcgccaccctggatgcccagttgaagaacatttccgacctggtggtcgaggcggtcgccctattgaacgacaagagcctcagtccggctgaccgggatgcgctgcatgccctcatcaacacatgcgagaacgacgccctgcgccacaccaaggcggccctggctgatctgcaagcgatccgcaacggctacgccgacgggctgcaaaagtcgttgaacagcctgcacgccgaagggtatgacggcgcgcccctccatggtgtcgacgccgacggcgtcgccccggcctctccggcccaacaggccgccttggatgacattcgccgggccaccaatcaggccgtcctggaccagatggccaaggtgcgtgccgcgcagcgggctctggacaaggcgatggccgacgtttatgcccacgggcccggctcgccggaaggcgaggccgccagcgcccagctacccaagctcaaggccgatctcgcccatgcgctcgacgacctgggcaagattcccgactacaccggcatcgaccccgcgtcggtgaatgtcacgcccgatggccacttcatgttcacctacaacgtcaacgggcagcccgtacaggttgtcggccagctcaagcacgggacgggcgaattcttcgaccaggccaccggcacgtactacaccttcaacggcggcaagttgaccggaatgcgcacgcccgatccggggaaggtggaagccacctccgagcccttgtggaccgccatcacgaccgcggtaggcggatacggactcaaggtgggcggtactgccgcttggcaaggcctgaaaacgctattcagccgggagatgttggacggattgacgagcgagaacgttatctcccgggcgatgacgggggctgaggtgcgtgcggcgctcgctgaggccgagtacccgcgcggcatcggcggcgaggccgttcccagtacccatccgcttgagcctcctcccgtggagcacactcccccggccgatgcacccgtcgaacatgcgcccggtgggccgcacgtcgccgtgcccgacagtccgccgcctttaccgccggaacagccgccgccacccccgcttgcctcggaccatccgctcttcgagggataccatccgatcgatcccggcccggaattcaccaacgccgacggcagcctgcgatatcccgacgacacgttgccgaccaagccgtacgcggtacccgggacggtcgtcccggatgctcagttgtcggctgggacagttctgagccgattcgggtttcccggtggcggatacctggcccccgaaggaacaccgttcgccgaactggcactcccaccaggaagcgccggcaagccgtactttcaatatgtggtcgacgacccgacccgccttccgcccgggtggcacattgagcagtcggaggtggcgccgtggtttcatcagcccggcggcggtcagcagtaccgcattattaacgaagagggagagacgggcgatgtcgcggaattggtcaggtggggctacttgagaaggattaactaatggtcgatttctcgcgcttgtcagtcaattggcatcggtggggacccgcaataggtggcggtaatatcggcgtcaccacagagtgcgaagactgtacaattcgcttcacaagtaccgactattctgtccacgtccgtgaagaacaaacttggtgggtagtcgatacggttaacgaccgtgggcagcgccgcaacgcggctgccaaactgtcgaatttcgagttggccgaaaagtatctcatttgggactgggccacgacggcgcgttcggacctcgcttctggccgtctgggcgccgaccttgccaagcaaggattcgccccgaaaatcgaagtatccaaaatcgacacgaaatacaaaatctgctcaggtaacgattgcgccatcttgtctgaggtgaacgccaccatcttcagccatctgatcgataaatcggtggatcagatcgagcggctgattacgggtgagcccagctgatcgtgtggtaaacgccgattccgcggcccgccgcgcgagggggctaccaatgccacccactgcgggacttccggcgtgaccggatctgtgaagccctcgcgttcggatgcgtctcgagcacacgtggcgttgcgccgagcagatggtcagagaaggcatcgcataatcggtcgaaactgggcagccgaacacccgctcaactgcagtgtcgaaccctcccggggccgttgaaacgtccgcacggcctggtcggaccgatggttcgcgcgagaacagatcgcgaaacacgttgtcacactgagtaattgcgccccatccggaattcaatctggataacccgctgaactacatgccgcccgagttgcgagcgctgtccgaacaacatttgaccggcagcggcgaaaccgtcctcggcccattcaaaaatccgtcagggggaccgtcgtatatcgagcccgctcagcagcgaggtgcgagctatttcgatataggggatgcatggaacgcgtcaaccccggttgagcgactcgcagccaatcagcatgttctcgacatcgcaatcgccaaccgagacaccataaagggttgtgccccgtgaagtggtgtaaagccgatcggcgtttcgcctgaggctctgcgagtttccactatgccgtgatggcggcggggacggcaacggattggtcggctgaatcggagcggggatgtaatagggccagggtggtctcggagagatagcgcttttcggcgacttgccattcgtcgtgggcttcgacgagaacggagccggccagccgtagcagcgcggcggggttggggaagacgccgacgacgtcggtgcggcgtttgatctccttgttgagtcgttcgagggggttggtgctccagatctttttccagtgcaggacagggaaatcggcgaatgcggtgatgtcgtcggcggcctcgcgcagcatcgtttcgaccttgggcagttggcggccgagcatgccggcgatggtgtcgagttgctctcgcacatgttcggcgtcgggttgggcgaagatggtgcggatcgctgcggcgaccatctcggctgatcccttgggcacctgggcgagcacgttgcgcaggaagtgcacccggcatcgttgccaagatgcgccgatgaggatggcctcgatggcgctgcgcaacccggtgtgggcatcagagatcaccagctgcaccccggacaggccgcgggttttcagtgagcgcagaaacgccgtccaaaacgcgccgtcctcggagtcaccgacgtcgaagccgagcacttcacggcgtccgtcagccgcgacaccggtggcgatgacgaccgcttgggagaccacccgatggttgacccgagccttgcagtaagtggcgtcgaggaacacatacgggaagtgctgttcggatagaggccggtcccgaaaggcgcctacctcggtgtccagatcggcgcaaatccgggagacctcgcttttggagatgccggcgtccgcgccgagggctttgaccaaatcgtcgactttgcgggtggaggtgccgtgcaaataggcctccatcaccaccgcgaacaagcactgatcgacccggcggcgccgctccagcagcgccgggaagaacgagcccgaccgaagcttgggaatccgcaactccaaatcgccagcgatcgtcgacagtgtgcgcggccgagacccgttgcgctggttgattcgtgatgcgctccgttcatgcggaccggcgccgatcaccgccgtcagctccgcatcgatgagtgcctgataaatcgtctcggcggcctgcttgatccgatcagcggcatcggcattgcgtaatgcgtccagcacctccagcaaggcagactggtccagggccatcgcgatgttcctctcggtagtgatccttggtcgtttcaccacagagactcacgcgatggccctctacatcagtaccgacacgccgccactatttacaccacgccccggcacgttcccccataaagctgtcaacttcaatcgatagggttctggacaacacgtataccgccgcggaactccgctatctaaaggctcatggctaccaagtcgtcgacggctataccctagttccacccaagatcggaggttagcgcggatgaaagcgctccttgaatttatcgttcaatactgtggcttcctctacctcaaccccggctacagaatcacgaactcggccacccgaggcttggccgacatcgacgcatcgattacgttcaccggcgaggagatcgggtggcagatcattaatgatcgcgggctcatctactttgctgcggcgccgtcacaaggtgtgtccgacgattcgtatgcactttcccttattcgtcaatacctagaaggcggcgaggatgtcggtgctggccccgcgatcgacgaggcgagctggttgagcgcaaacttgagccggatcgagcggctatttaccgatgaatcgaacgctgcgcgcgtctgcgacgaacttgccgatctacgacgctccaattcattcaaaaaatggggatggcccaaaccggaggaaaccgactagcggcaaatcctagaccagtggagtccgcggccgataatgcagagcttgctacggtgccttttacgtacttcgacttcctgtatttagacgctcgatatcgcctcgcggattcgacgacatccggaagtccgacgagcaaatcttcattgactttgactggcccggttgtcagttgggagctgattaatgacaggggccagttcggatgatgaaacgaatgcggtatcgccggacgagaccattgcatggatccgaagcaacttgagccgcatcgagcaattcttcaccgcggccaagcggagcattcgtgtgagcaactcattgatctcgcaaaggcccttgcaacaaagtacttcggctcatcacaggagtgaagctgctgccgaacggcgaccaggggctggcggtgaaagagcgttcattatgcggctgtacctaacccgccgcgcaccaggctgccaatgcagccactgcgggacttccggcgtgaccggatctgtgaagtcctcgaggtcggatgcatctcgagcacacgtggcgttgcgccgagcagatggtcagagaaggcatcgcataaccggtcgaaactgggcagccgaacacccgctcaactgcagtgtcgaaccatccccgggggcgttcaaacgttccacggcctggtcggaccgatggtccgcgcgagaacagatcgcgaaacacgtcgtcacaccgcgtaattgagccccaccggctagttggttgttggtggtggttggggttggaaggggtcgtaccaccaccagtcggcgcgttggccgaggggtccggggcacggtgggacggcgggtgggggtctggtcggtttgcgggccagtgatcctggtttcaggtggcgcccggagctgtcggtgacgaggagggtgtcggcggggccggtgatggtgatctcgccgcggtggtgggcgcggtggtgataggggcagaccaggaccaggttggacagttcggtggggccgccgtcttcccagtgccgcaggtggtgggcttgcaggccgcgggtggcgccacagccggggatcgcgcagccgcggtggcggtgttcgagggcgcggcgtagccgccggttgatcacccgggtcgagcggcccgcaccgatgggttggccgtcgcgttcgacccacacctcgcaggtagcatcacaggtcagatagcggcgctcggcgtcggacagcagcgggcccaaatgcaggccggcgatgcgttgggcggcgtcgaggtggaccaccacggtggtgtggtggccgtgggggcggcggtgcgcctcggcgtcccagccggtttcgatcaggcggataaacgcctccagcgtgcccggcaacggcggcaccgactcgccggcccggtggttgtggtcgcgtttccattcggagatcagcgcttcgcggtgcgcggccagggcggcgtcgaatgtggccgcatcgaggcggtcgagcttgatccgccagcagctgagctcctcgtcggaggtcttggtgaggccgggctgcggtgccggcttggcctcgggttggggccgcggttccagcttgaccgcggtgcgcagctggttgaccgtggccaccgtggccagctgcgcgtaatgcgcatcggatcccgccccggcacgctgcgcgatgaccccgagctggtccagcgacaaccggccctcccgcagaccggccgcgcagcggggaaacgagtccaaccggcgcgccacggccgcgatcgtctcggcattgcccggtgagcagcccgtcttccaggccaccagcgcgccaagagaccgcgccccggtggctccccacagctgctcgcgctcgatctgcgcgacgatctccacgatgcgcccatcaatcgcattacgctgcccggtcaactccgccaactcgtcaaacagcaccgccaaccgatcgcaaggacgcacctccacctcagctgccagcacgctcgaggacatgacaacatcatgacaacggggtccgacaagtcgcgtcggctcgatctgcgccagctacgaatgcacccaccgcgtgatctcgggagtgacgggatcggtgatgtcgtcgaattccggatgcttcttgagcacggtgccgatcatcgagcacaccgggacaatgcgcttgccctcattccgggcctcgttcagcgcctcctcgaccagaatggtcgccaggccgcgtccgccgtacgccggatcgatttcggtgtggtagaagacgcgctggtcaccgcggtccttgaaatcggccagtcccacgggtttaccctcgacggcgatggtgtacttgccgtcctgaaggctgaccgtggtttgtgctccggtcttatcggttgtcatttgtgcttccctttctttccgggatcggtcggggccgcagccgagcggtcggcaacggcggggcgggcagccggctcagcgcaccacggtatccccgcaccgcgccgaaccgctcgtcgccgtcctcccacaatcggcggtaaccgacgatgtcctcgtggcttcgcccgacgaagttccaccacatcaccaactgttcgggaaacggtgtgccgccgagcaatagcacccgcgcgggcgtatccccggcgttgcgcagttgcaccgcggcgcgccccggccccaggtatgccaattcggcgacggacaggggcttctcgtcgacatgaaccgcgcccgcatcgcagagcagcccgtgttcaaagttggggtcgatgtcgaggtccagctgggcgccggcgccgagatcgatctgggcgccgaccagcggcgtgaaagtccttaccggcgaacggcttccgtgcagctcgccgagaaacacccgcgcctgcgcgccgggtagtgagatcggcgggggcgcataatgcgcgaagtcccgcgcggtgtcgcgatcggagtcgggcagcgccacccacagctggacgccgtgcaaagcccccgagcccaccgacacttcggaatggcagataccggcgcccgcggtcatcaggttcagctcgccgggccgaacggccgcgtgtacgccggcgctgtcgcggtgttccacttccccactgaacaaccaactcactgtctgtagtcccgtgtgcgggcgcggcggcacgtccatccgggtgtgggccggtccgtaatgatcgatgaagcaccatgccccgatcagcgaacgttcgcgttgcggcaacgtgcgttgcacccgcagcgccctcggcccgcccaggggaacctcgcgcggacgcaggatctgtacggccggcgaggcgtcgcgatcccgcgaagcggcgcaggcgacttcggccggtgcggcttcaaggttgctcatcgtgcttacctacccggcggccgcagcaccttcatggccagccgcatgacgggttcggggatgcgatcctgcattgacagggcggcttcggcagcccgggatcgcagcggggtgccgcgcccgaacacccggttcagcgctcccccggacggctcgagcaccacgtgcagcggcggcgttccgacggcagcccccagcgcgttggagacgaccatccgctggatctcgctggtgccttcaaagatggtgtacagcttggcatcccgataccacttctcgaccggatgatcggtgatgtatccccacccacccagggtttggacggcgcgctcggtggctttgaccgcgacctcgctggcggccatcttcgacatcgacccctctccccgctcgaagggcacgttgttggccgccatccaggacgcccgccaggtgagcagtcgagccgcgtcgatctgggtggccaattccgccaacgggaaggcgatgccctggttgtcgatgatgggcgccccgaacgcctcacgctcggtggcatagctggtcgcgtattccagtgccgcccgggcgatcccgatggcctgcgcggccaccatcggccgggtttgctcgaaggtgcccaatgttgctgagccggaacgctttccacccgccacgacctctcgggctttggccagcttgtgctcgagcttctcctgtccgcccagcagattggcggccggaacgcgcacaccctcgaagagcaattcggcagtgtgggaggcgcggcagcccaacttgtcgagcttgcgcaccattttgagccccggcgtgccgccgggcaccacgaacagcgcctgaccgcggtgcccgagctcctcgtcgaccaccgcgttgaccacgtgcacattggcgatgccgccgttgccgatccacatcttgtggccgtcgatgatccaatcgtcgccgtcgcggcgggcacgggtgcgcaggttccgcacgtcgctgccgccttccggctcggagattgccagggccgccagcttgagatcccctggggtgccgaaacattcgggcgcccattcgagcatctgctccggggatgcggcctggccgatcgccgacagcgccagcgccggcatgacgatcgccaacccgatcccggcgcagccccaaaacagctcctccatgaacatcggcagcgagatgccggtcggatcaccgatcagatcgcgataaaacagcgggctgtagaagccgcgccgggccgcctcctccagcaccggccacgggaactcctggcgctggtcgtactcgagggccactgggcgtattacggattcggcgaactcgtgcgtgcgccgggccaggtcgtgttgcgctgccgtcggggtcaggtcgaacgtcatggatgcgcctctaggtcgacggactggtcttgccgacccggactaccccgttgacccggtcagcaaactgcggcccgggactgcggcgaaatgtcaggcggccgaacggggcccgaccttggccagcggcagatgcagcacgactgcgggtgcggcgacggtctcgtgttcgtgccgcgccagcagcgccgcattctccggcagctgccgggagttgatctcgccggatgcgatgcgccgcagcacctcatgggcgtgtgccagctgctcacgcttgcggtactggccgcccggcagcttcaccccggcccaggcgccgtactcctcgcgatgcgcgacggcgtgctgggcgcagcgccgctgttgggccagcgggcaccggcgcaggcactggatgcgcgcctcggtggccgaccgctcgtacgcgcgggccttggccgcgccgtcaccaccgtcgtcgtcggggtagccgaaccaaagttccgggttggctgcgcacgggtgtcccatgtcggtccttacctttcttgaagggtgttcggggccgtcggccttaggcttcgaattgcccagggacgtcgggtatggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttccggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatctccttgtcgagcgtgaaacgtaggcaaaagcgtatatctctaaccgaaggcgcgcaagagaaacgtgacgaaaacgtatacacagaggtttgaggcctcagctgtgtaatatccggcctatggccggagcgtgcggtgagccgtgaatcggccggcgcagcgatccgcgcgttgagagaatcgcgggattggtcgctggccgaccttgccgccgcgaccggtgtcagcatcatgggcctgagctacctcgagcgcggcgcccgtaaaccgcacaaaagcacagttcagaagatcgaaaacgggctcgggctgccgccgggcacgtattcgcggctgttggtggccgccgacccggaggccgagctggcccgcctgatggccgctcagccggcggccgagatgccggcgcggcgcaccggaccggtggtggtcgatcgtcacagtgacaccgaagtgctggagggctacgccgaagcgcagctggatgccctcaaatcggccatcgatcgattgccggcgacaacatcaaacgaatatgagacgtatattctgtctgtgatcgctcagtgcgtgaaggcggagctgctcgccgccagctcatggagggtggcggtgaacgccggcgccgactcgaccgggcggctgatggaacacctgcaggccctggaggcgacgcgggtggccctgttgaagcggatgcccaccagcctcagcgcgcgcttcgaccgggcctgcgcccagtcgtcactgccggagaccatcatcgctgccctggtcggggtggatgtcgacgagatgtgggacatccggaaccggggggtcatctcgccgagcgccctcccccgggtgcgtgccttcaccgacgcggtcgagtcggcgagccggaatggggcgagccggggcgacgacgaggaggggtcgtgagccacagcgaactcgaggcgttgagccgtgctcatcaacttttcgccggcggcacgcggcccgcatccctggacaccggaagtgggcactaccgcgacctgttggggcgagcggcccggctgagcgacggattcgcgcacggcggctaccggctcgcggtgcagcacagccggcaacgcctggcgtcgacgtcggacacggacgccgcggtgaccgacctgctggccggcgcgcaccgagaccgggcgcaggctcgcgagctgaccggcgccgtgctcgatgccggccgcgccgacgccgcgaatccgacgacgccgttggctcagcgcgaggcgatgcggcgccgggtgatgcggctgcggacccaacatgcccacgtggtgtcggcggcagcgcgagcccgacaccaccatgcccggctgctggccctgcggtaccggctgcggcacggtgtcgggctggccggcctgcgcgggccgggcagcgaccgcgcggcgctcgcggtgcgggccgcgttgtcacggctcggccgcccatacgtgtggggggccaccggtcccgaccagttcgactgctccggcctggtgcagtggagctacgcgcaggccggaattcatttggaccgcaccacctatcaacagatcaacgagggcatcccggtgccgcggtcgcaggtgcggccgggtgatctggtgtttccccacgccggccacgtgcagctcgcgatcggcaacaacctcgtcgtcgaggcgccctactcgggcgcctcggtgcgaatcagccggctgggcaacaacgttgcgatacgccgaccgatatgacctgccaacatcgcccggcccagcgggcacgacgaaaagggtgagccgatgccggaacaacccgaatactcgttagaggccgtcgaggcgcggcgatcggcgctggccgatcagcacggcgcggcgtcggaagccgaccgtgtgctcgccgaggtgctcgccagtgctcacgcggcggcgcaggagagcgcccggcggctggacgccagcgccgagcagatcgaccgcgccgtggcgcatcaagcggatctggccatcgatacgccgctgggcgcgcgggagttccacaagtttctgctcgccaagcagcacgagatcgcgtcggtggtcaccgaggcccaggaactcggcagggcgaaaagggttgtgttggagaatcttcgggcgcagtacagcgccggcaacaggtgagcaaaattagtccacaccgtgggagcgcagtgaattgtcggcagcaacactcctgagtactgtcgccgggcatggaggggtcgcgtcaggggctgcagcgcttccgggcgggctgatgtcggcctacgacgacctgttggccgcggtcaaggacgtccgggaccgcaccggcgacccgaacgcgtggcaaacgggattggcgccggccgaagtgtcggcggtgatcaccccgagcacacggcccgaacagctgcaggccatcctggccaagatccgccggcagcacgcggaggtgttcggggccgcaccgacgggcgtcgcacggccacccgccgatgccgggcctgctccggaccgggagtcgggcgcggcggccgatgccatcgccagcgcggaagccgctctggcacagcagaattcagtgagctcgcagctggacatgcaagtcgtgacggccatcctcaacgcacacctgaaggcggttgacggcagagaagcgctcaccaagttgcagcaggaaaccgaggcggccgtccggaccaggtcggacctggacaccccggcgggagcgcgcgatttccaacggttcctcatcggcaagctgcgagatatccgggcggtggtgctgaacgccagcctggacgacacctcgaagtcggcgctgatggccgcgtggacgtcgctgtacgacgcggccaagagtgatcgacccggcgatcacgcgtcgtctgccggcgccgctgccgatgctgccgcggcgggcacgagtgatcagccggacgaggatctcgacgacgagtgggatccgctgctggattcgctgttggccgacgacgacggatcgccgatcgatcccgcggccgccctggatccattgggcggcaacaccattccaccggcaccaccgcctgcgatggcgcccgcgttgccgagtttcggcggtggctcgcttccggggctcggcgcgacaccggcatccatgtcgggctgggagacgcccggcgggcttccgctttcggggctgcaggccggcgacgccagcgatccggcgctgcaggacctgggagacgaagacctaccggaagaccaaggccagcaacacgattcgcctgccgacggttcggcagaacaggccgacgacgagaacgcgtcagccgacgagccgccggccgggccgacatcggtgacgctgcccgacggcgaaacggtggccgcggccagcccgcagctggcggcggcgatcaaggccgccgtcggcggaaccccgatcgcggaagccttccaacaacagggaatgaccctccccacacccgggacggcggtggccaaccccgtcgacgttgtgcgggtgagtcccggcgacatcggcatgttcaccgatcgccacgccctggcgctcggccccggcaaagcgcttctggacgggcaaattcaacacatcgccaccgtgagcgggccgggcttcctaggctgggagcacccgccggcggcggccgcgagcgtgaccgcgccggctaagcccgacccaccgacaccgacccggccggcgagctcgtcgaccacctgagaaaaatgaactcgccggcaggaccggcggtcctcaacaggagacagcggatggcagattcgatccatgtagtgcccgcgcacctgcgtcaggccgctgcgcatcaccaagacacctcggagtacctgcgcaccgtcccgtcgtcgcacgccgccatccaggagagcctggattcgctcgggccgatttttagtgaactgcgcgacgccggccgcgaacttctcgagctgcggcgccagtgttacgagcagcaagctgctgaccacgccgacctggccgaccaactgacggtttcggcggcgatgtgggagcagcacgagcaggaggcggcagacaagttcggcagcatcgtcgaccgcggtcgatgacggacgcgaatcccgctttcgacactgttcacccgagcggacacatcctggtccgctcgtgcggcggcggctacatgcacagcgtcgcgctgagcgaagaggcgatggaaaccgacgccgagacgctggcacaaggcattctgctgaccgccgacgtgtcctgtctcaaggcgttgctggaaatccgcgacgagatcgtcgccgccgggcacacaccgtcggcggaagttccgaccccgcgcgacctcgatgcggccatcgaaaagttgctggcgcacaagttgcgccgccgcacgcacgccaagtagacggctcggaccggtctcagccgaggtgttcggttagcgcagccacggcttggccgcgctgggatcgggagcgataccggtcggcggctctaccggattggggccgaacaactctcgcgctcgggcgagcagcgtgcgcacctcgtcgagttgctgctgcaatgcagaatcagccatgtccccacgctacccaggccttgacggccgcacaattcactgactgcacaactcgccgggcggctgccgctaggcttagccggtggcgatcttcggtcggatgacggcgcgtcagcgcctccggagagctacccgggaatcactgtcgattccggccttcagctctcccgtcgactgcaccccgtgggtgacaggcgggctgtggcctgccgaattgtcgacggtcacgcccgaaaccgccacgctcgcagagtatctcaaggccgacctgcagcgaattgccgacggcgccaacgatgaattgcgcaagctcaagcgcgcgggtatgaccgacaccgcccggcaggctgccgaggcgcgagtcatcgagcaggcccgcacgcgtgcggtgcgacgggtcgaatcgacgatccgctacctgcatgcggtgcaaagcggcgcccggccgccggctccaccgcggccgaccctcgatgctcccggcgcggacttggaaaggacgcaggtgctgcccgcggtcggcgacgctgagcacaccgccggcccgccagcgcagcagacgcccgaagcgcgcccgcgaccgacccggcggcgggcggccgaggacgagccggcgcaactcgaggagacccgggtgcttccggccattcgcgacgacgcggcggccgcggacgcttcggtcccggagacgccggcctcggaagcacctgtcccggaggcgccggagacgccggccccggaggcaccggccgccgaagcacctgtcccggagccgctcggcgaacccaccacccgcggccgccaccacgcaccggtgcccgaaccggtgcccgagcacgtcgaaccggacatcgccgcacccgccgaggcggccgacctggagcagacccaggtcatcccggtcgtcaggcgagacgagccggtccccgagccgccggtcgttgccccaccggagccggccgaggagcccgcggacagcggccggcaccacgcgccggcggaccgcgacgagccggcgaccgaaagccggcccgccgtcgccgacaccgaaaccgcccagccgcgcgtcgaaaagcccgcgcccacaacggcattcgacaacaaccgcttgaaccggctgctggaattcgtggtccggcaagagccgcggctgaattgggcgatcggcgatcgcgccgacgggacgacgatcctggtgaccgatctcgcccacggatggataccgtcgggcatcgccctgccggcgggcgtgcggttgctggaacccgagcggcgcagcggcgacgtggtcgcgctgatcggcgagacggtacgccgcgtcacctacacacccggtgatacgctgcgccgctcggcggacttcgccgccacgcagtcgtcgtcgcagccgcgtgaactgccccccatcgacgacttggcgacagcgatcagccgggccatccgcgggcgcgccgacctgcccaagatcgtgccgcggctggccgacgcggcggccgcgggcgcggtcatcgtcgaccaggaggtcgacgtcttgcgggtgcacctggacacggcccgctatcagctgctggtgcagtatccgaacgtcaacccggcgctgctgctcaagtgcctgttgatggccgccaccgaaggcatcgccagcggcgacccggtgtccgcgaactaccacctggcctggtaccgcactctggccgcgccgtcgcccggaggttgagccggcaaacccgtcgtatgaattgacgctggtcggagggctcgcgatactgtgcaggtgtcggattcgggcagtcgcgcgaatctcagcgacaaggatctcgtcgaatcggttcttcgcgaactgagcgaggcggccgacaagtgggaagccctggtggcgcaggccgaggccgtcacctacagcgtcgacctgggcgacatctacgccgtggccaattccgacggccggctgctgaagctgaccctgcatcccggggtgatgaccgggtacggccacggcgagttggccgaccggctcaacctcgcgatcaccgcgctgcgcgaggaagcggaggccgagaaccgggcgagttacggcggtcccctgcactgacgcgcctcccctgcactgacgggttcgcgcgtttcacgcgctcatcgcccggggccgggcgggccggcgaaggcctgcgcgatctccagccagcgctgcgcatcggcgccgaaggcggtgatgtcgagcgcgctcagcggccgccgctgggtgaccaggaagcagaaatcctccgcggagccggtgacccgctgcgccgcctccggcggcccccacgaccaggtgtcaccgccggggccgcacagctcgaccaggaacggctcggccggcggcgtcagattgttgacggcgaacgcgtaatcgcgggtgcgcacgcccagatgagcgatcgatcgcagccggtcggtcgccggccgggtgacccccagcgcgtcggcgacgtccaggccgtgcgcccaggtctccatcaaccgcgcggtcgccatcgacgcggcgctcatcggcgggccgaaccacgggagtttgcgcccggccggcacccccagcagcgcccgatgcagccggtcgcgggtggcgcgccaatccgcgagcaactccgccggggcgacggccgcgagctcttcggcgcccttgtcgacgaagccggccgggtcggcggccgcgccggccagcacctcggcgaacccgggttcatcggtgaccgcgatcagcgcgacccgatcggtccacagcagatgcccgatctggtgggcgatcgtccagccggccgccggcgtcgggtcggcccagcggcctggcggcagcggtgcgaccagggcatccagcgcgtcgctctcggcgcgcagatccgccactatcggggccggaccggtcattgctgcccccgccggtcggtgccggccgtcggacaattcacgtcgccaccttagcgatcactcgccgcgccgcccgacgatgccgtgcacggccagcccgaccagatagagcaccgacccgaacagcgcgaacaccggggcgtgcccgtcgtcgggaatcaccatgccggccaccgtgatcgcgacgatgaacgacacccagaacagcgcatcctgcaccgcgaacacgtgtccgcgcagcgcgtcgtcgacgtccatctgcatcgccgaatcggcgcacagcttgaccatctgcccggtcaccccgagcaagaaaccgcacaccaccatcaccggaagcagcagttcggcgcccgcgacctcgacgatcgccgacgcggcgagcgcgccgttcgcgctggcgtagcggccccaccggcggatcgcgggcggcgtcagcacgttggccaagaacgcgcccaggccggcggcgccgaagaacagcaatgcggtgccgaatcccccgccctcgaggcccggcaggtgatggaccagcaacagcaccagcagcgaattgatacccaccaccatccggtgggcggccaggccggacagcgtggccgcgaccgtcgggcgctgagccaccgtccgcgccccgtgcagccagccggtgatcaccgcatagagcaccggcccgtggatcgcccgccaggtgtcgtcgggacccagcgcccgcggggcgaaccgccacgacaacagcaacgcgatcgagaccggaaccacggtgaggaagacgatcgccgcggcgccccggtcgccggcgccgaacaggaaccgcggcaccagcatgaagttggcgccgagaaacgcggcaacgaccccggccgcggtggccaccgcgttcatcgtcaccacctgctcgcgcggcaccacgtgcggcagcgacgccgacaatccggacccgacgaaccgggccaaaccgttggcgaacagcgcgcccagcagcagcggcagatcgccggcccgcaccgccaggatcgtgccgatcgcggcgatgagcaccagccggcccacgttggcgccgaccagcaccagccgccgatcccagcgatccatcagcgcgccggcgaacggccccagcagtgagtacggcaggaacaggaccgtgaaggcgcgcgcgatggcaagcgggtcggcggcccgatccgggttgaacagcagcgccccggccagcgccgcctggaacaacccgtccccgaactgactcgccacccgcacctgcagcagccgccagaaatccggcaacgcgcgcaccgagcgccagatttcgacgggtgcgctggactgcatccgggttggaatcaccgaaaccgacttccacgattggggctggaacgctggcgtggtcagggccgtgccaacaacagtacaaatcttcgtgccccacgctcccgattgccctgggcgacgatcgggcggatgccatgatggtggggtgccgccgccggaggatcccgaggactacgtcgcacccgccgcgcaacgggtgcgggcgggcaccttgctgctcgccaacaccgacctgctggagccgacgtttcggcgcagcgtgatctacatcgtggagcacaacgacggcggcaccctgggtgtcgtgctcaaccggcccagcgacaccgccgtgtacaacgtgctgccgcagtggaccacgctggcggccaagccgaagacgatgttcatcggcgggccggtcaagcgggacgcggcgctgtgcctggcgacgttgcgggtgggcgccgatccgcaaggcgcaccgggcctgcggcacgtggacggccgggtggtgatggtcgacctggacgccgaccccgacgcgatcgcgccgttggtggaaggcgtgcggatcttcgcgggctactccggctggaccatcggtcagctcgaaggcgaaatcgagcgtgacgactggattgtcttgtccgccttgccttccgacgttctggtggggcccaggtccgatctgtgggggcaggttctgcgccgccagccgctgccgctgtcgctgctggcgacccaccccatcgacatcagccgcaactagctggctcccccgccgtcacgcgcacgactgcgtgcagccggtgcagctgccggcgcaggccggcgcggcggactgctggcgcaccgcgaagcgggcgctctgccacgagccggcggccagggtccccagcgccccggcgacgcagacgatgagcacgaccagcgcggtgtgcgggaccgctgccagcgccaccgtgccgccggcggccagcatcaccgcggccgccaactgggtgggcgccatggcgcgcagcgccagcgcggtggctccgtagttccggttgtgcgcaagcgaccaggtgccgaaccccgccgaggccaccgccgcacagatgcacagcacgcccgcaatcagcatggcctcacaatacgagccgggtcaccgccgcgcgcagcgggccgggtcggcgttctcagtgctgcaggaacgagaagttcggcagcgggggcaggcccggcaccatggccagcaggctgggggtgtgctgctggttgggcagcggctgcgcgggcaacccggccggggccgccggagcggtctgggcgagcggcaccagcggagccgccgcggcgggcgccggcgcggtcggggcggcgggggcgacgggtgccggagcgacgggagcgacggccggcgcctgggcgggcagcgcgaccggggcggccgtgggtgccggggcgctcgcgccgggcacggtcacccggaatccgttgacgatggcgtcggtggccggggcgtcggccacggcgaccgcacggtcggtggtcaccgccagcgaaaccaggtatttgtccggccccgaggtggcgatgacgtgacgacgcgaggtgttcagcgtcaggtcgccgtcacggtaggtgccctccacgatcgacgacgggaagccgccgaaatcggccatcgaggcgttggtgggctgccacgccggaagcttctggctgtccacgtagccgtgggtgatggcttccctcggatcgaagttgccgaccagcttgtacaccacgacctgggcattcgacgagtagatgctgctgccgtgccggtcggcgatcaccgcgaacgcgtcgggcacgttcgggtcgggcacctgggtccagcgggcgggcatcggcaaggtgatgtcgagcgccttgaacccctggggcttttgcgcctcgaacttcacgcccttggactgcaggaattcccggatcgtgcccgaggtcgcgggagcgggagccggggccggcgccggggccggggccggagcggggcctggggtgcccggcgtggccggggtgacctgggtggccgcggtggtggcctgcggcgcggcgaggtatctgctcggcggcaccagctcgggcccgaggttcgccggcgccggcgcggggacgggcgcgggagccggcggcaacgggtctgccgatgccgtaccgcccgcagcaaccgccaggccgatcaggccggcgaccataccgccgagaagtgcccggtggccggggacgatctcaatcatctgcgtcggtccttcccatggctgcctaccagaagccgtcgatagtggctgactgtaactacaggtcaaaggcggtgaacaggctcgaaatacagctgggatgaacccctgatcggtgcgcaacgcaaccgagaccaacctgtggccggcgaacccgccgcgtcggcccttataccctgttcaggtgaccgaatccccgaccacttcgcccgccaccggctccggtgccgccgcgccggactccgacgcgccgccgtatcgctacaccgcggcgctggcgggccggatcgagggcagctggcaggacacctgggccaagctcgggacgttcaacgtgcccaacccggtcggttcgttggccccgacggacgggaccccggtccccgaggacaagctgttcgtgcaggacatgttcccctacccgtcgggggaggggctgcacgtcggccacccgctgggctacatcgccaccgacgtgtacgcccgctacttccggatgaccggccgtaacgtgttgcatgcgttgggttttgacgctttcggcctgcccgccgagcaatacgcggtgcagaccggcacccacccgcgcaccaggaccgaggccaacgtggtcaacttccgccgccagctgggccggctggggctgggccacgacagcaggcgcagcttctccaccaccgacgtcgagttctacaagtggacgcagtggatcttcctgcagatctacaacgcctggttcgaccccgccgccaacaaggcccgacccatcgccgagctggtcgccgaattcgattccggcgcgcgcagcctcgacgacgggcgcaactggtcggagttgtcggcgggggagcgggccgacgtgatcgacagccaccggctggtctaccgtgcggactcgatggtcaactggtgtcccggactgggcaccgtgctggccaacgaggaggtcaccgccgacgggcgcagcgaccgcggcaacttcccggtgttccgaaagcggttgcggcagtggatgatgcggatcaccgcctactccgatcggctgctcgacgacctcgacctgctggactggccggagccggtgaagaccatgcagcgcaactggatcggccgttccaccggcgccaaggccctgttcgcggcgaccggcgccgacggcgcggcgctcgacatcgaggtgtttaccacccgaccggacacgctgttcggcgccacctatatggtgctggcccccgagcacgagctggtcgacgagctggtcgcgcccgcctggccggacggcaccgacccgcgctggacatacggcgccgccactccgggcgagtcggtcgccgcctaccggcgggcgatcgcctcgaagtcggacctcgagcgccaggagagcaaggccaaaaccggtgtcttcctgggcagctacgccaccaatcccaccaatggcaagccggttccgatcttcatcgccgactacgtgctggccggatacggcaccggcgcgatcatggcggtgcccggccacgaccagcgcgactgggacttcgcgcacgaattcggcctgcccatcgtggaagtcattgccggaggcgatatttcggagggcgcctacgccggcgacggggtgttggtgaactccggctacctggacggactggatgtggcggcggccaaggaggcgatcaccgcccggctggaagccgaaggccgtggctgcgcgcgggtcgaatacaagttgcgtgactggcttttcgcccggcaacggtactggggcgagccgttcccgatcgtctacgacagcgacgggcggccgcatgccctcgacgaagccgctctgccggtggaactgcccgacgtgccggactattcgccggtgctgttcgaccccgacgacgccgacagcgaaccgtcgccgccgttggccaaggcgaccgactgggtgcacgtcgagctggacctcggcgacggcctgaagccctacagccgcgacaccaacgtgatgccgcaatgggccggcagctcctggtacgaactgcgctacaccgatccgcacaactcggaacgcttctgcgccaaggagaatgaggcctactggatggggccgcggcccgccgagcacgggccgcaggatcccggcggcgtcgacctgtacgtcggtggggccgaacacgcggtgttgcatctgctctacgcccggttctggcacaaggtgctctacgacctgggccacgtcagctcccgcgagccgtaccgccggctggtcaaccagggctacattcaggcgttcgcctacaccgactcgcgcggctcgtacgtgccggccgaggaggtcgtcgaacgcgacggccggtttttctaccggggtcccgacggggagatcgaggtcttccaggaattcgggaaaatcgggaagagcctgaagaattcgatctcacccgacgagatctgcgacgactacggcgccgacacgctgcgggtctacgagatgtcgatgggtccgctggaggcgtcccgtccctgggcgaccaaggatgtggtgggcgctcaccggttcctgcagcgggtgtggcgactggtcgtcgacgagcagacgggcgagacgcgggtggtcgacggggccggacgggatctgcccaccggtaccctgcggctgctgcaccgcaccattgccggagtctcggaagactatgcggccctgcgcaataacaccgccgtggccaagttgatcgagtacaccaaccatctcaccaaggaacatcgcgacgcggtgccccgcgcggcggtcgagccgctggtgttgatgctggcgccgttggcgccgcacatggccgaggagttgtggctgcggctgggccacaccacctcgctggcgcacggcccgttcccggtggcggacccggcgtacctcgtcgaggacaccgtcgaatacccggtgcaggtgaacggcaaggtgcgcgggagggtgacggtggcggccgacgccgatcgggacaccctcgaggccgccgcgctggccgacgagaaggtgctggcgttcctggccggcgcccagccgcgcaaggtgatcgtggtcccgggccggctggtcaacctggtggtgtagcggtggctaccgccgggcgggccgcagcaccacctcgtgcacatgcccgtcgggcggggtggccaccacattggcgaccgcggccgcgacggtttccggcttcaaaaacctgtccgggtcgtagcttccgccttcgaatgcgatgagctcgcgctgcatgccggtgtcggtgcgacccggatacacggtggtgacccgcaactcgggctcgtcgttgcgcagcgagtcggcgaaggcgcgcagggcgaacttgctggccgagtaggaagccatgccgggggaggcgttgcgtcccgcgccggagttgatgaaaaccacctgaccgcgggcccgccgtagcgccggcaacaacgccagcgtgagctcaaccggtccaaagacgttgaccgcgaaggtggcacgccactcgtcgacgttcgagtcggccacgttgccgggtatcgacagtcccgcgttgtgcaccaacacgtcgagttcctccacgacttcacaggccgcctcgatgtcgccgccgtcggtgaggtccagcgggaacgtggtggcaccgagccgctgggcgaccgcgtcgagccggtccgacggccggccggccaacaacagggtgtgcgtgggagccagcgccgtggcgatcgccgaaccgataccgcccccggcgccggtgatgagtgcattgggcatgcggtggagtctaccgatcccgcgtcgccggtcgaaaagggttgaactgcagcccgtttcaggcttccttgcgtgccgggggcacaccggccggcccggacgtcgggtcgccggaggccagccgctccaacggcgccagcgccttcatcagcgtgtcgaggtcggactcggggagctggctcagcatcgccgccagcgccgcgcgccgattggccagggactcaccgtgaacggcgcggccgcgcggcgtgatgtcgaccagcacggcgcgcaggtcggacgggtcgcgagaacgcttgaccagccccaccttctccagtcgccggatcgccacggtggtggtgggagtccgcacccgttcgtgcgccgccaggtcggtcatccggatcgggccctgatcgagcagggtgaccagaatcgacagttgcgccaacgtcaaatccccggccgccgccccgctgggatcgccccgccgcagcatcgcaaacaatttggacagcgctcggtgcaaaccttcggcgagctcggcaacctcggccgcgttcgattcgctgtctgccataaatcgggagtctaacccgatatcagaggcgtacaagggagccattgccccgatggtcggttcggatcaaagcacttgggacaggaatcgctgcagccgttcggtctcggcggcttcgaatatctgctcgggcgggcccgattccaccaccttgccgtgatccatgaatatcaccgcgtcggacgccgagcgggcgaaccccatttcgtgggtcaccacaaccattgtcatgccctcatcgccgaggtcggcgatgagttgcagaattcctttgaccatttcgggatccagcgccgaggtcgcttcgtcgaaaaacatcacctgcggcgacatcgccaacgcgcgggcgatcgccacccgctgttgctgcccccccgacagcgtcgccggccgggcaccggccttgtgtttcaggccaactcggtccagctgggtcagcgccagctcgcgggccgcctcggcgggcagccgccgaagtttccgcggcgccagcgctacgttgtccagcacggtgcggtgcgggaagagattgaaatgctggaacaccatgccgatgcgctggcgcagctggtcgggatcgtcgtgcagcaccgacctgccgtccagcagaatgtcgccgcggtccggctcgtacaagcggttcagggtgcgcaacagggtcgacttgcccgagccggacggcccgatcaccgccacggtgctgcccgcgggagtgtccagatcgacaccgcgcagcaccgcgttgccgttgagggtttggtgaatgtctttgcacgccaacgaaaccgacgcgcgggaggcgggattgctcacgtgatctcctgcccgaaggtcagcatgtcggcaggctcctcggggtcgaccgtggcgcggccgcggcgcagccgggcgtcgatcatgttcaccaaatgcgtcaacggcacggtcaatatcaggtagcaggcgccggcggcgaccagcggcgacaagttaccggtctcggcgttgaggtcgcgacccacctggaacagctcccgctgatcggcgaccagacccaggaagtacaccagcgcggaggccttcaacagcgcgatgaattgattgaccagtgccggcagcacccgccggacaccctgcggcaccaccaccagtcgcatcgccgtcgcatagctgaaccccagcgcgcgcgacgcttccagctggccggggtccacgctctggatcccggagcgcaggatctcaccgatgtaggcggccgccatcatccccagcgcggcgatgccgagcgggtagggattgttgttcgtcaatccgcccacgatcggcccgatcccgagcccgatgagcaggatgatcaccacttccggaagcccgcggaacacatcggtgtacacccgggccggccagcgcagccaccgcgcatgcgagatgccggcgacggccagcaccatgcccagcaccagcccgatcacgctggcgctgaaggtcaggatcagcgtgttgggcaacccggtgcgcaacaacgtggggatggcctgccgatacatgtcccagtcgaagaaggagtcgcgcagctgcgccagcgtcgatttcggcgccgccggtcccaccgccttgtgatgctgactcgccgcgatcgccgcgaagtccggcagtttggggggcgccgcggcctgggagccgggtttccagcccggcggcagggtgcggggcacccactgcgagtacaggttcgaccaggtgccgtcggcgatgacggcatcgaggccggagttcagcgcatccaccaagggcttgttgtccttggccaccgcgtaggccacgaaattgcccgggctgatcgtgttcgccaccaccaccgccggatcgcccggctggatggtggtcgcggcctgaccggcgggcgccacccaggcgtcgatctggcgggtcttgaggctggcgtacacggtggcgaagtcgggatacttcaccggctgcagatgcaacgtgtcgaccacgtaggactcctcgacggtgccctgcaccaccccgatgcgctgcccggcggccaggtcggtgaattccttgatcgcggaaccgggcggcaccaccagcgcgtagtagccgaagtcgtagccgttggtgaaggccacggtttggcgccgctcgtcggtggccttgatcgacgacgacccgacgtcgaagcggcgcgacgccacctgggccagcagcccggcgaaatccgtgccgacgaaacggacttggaggccgagcttgccggcgatcgcgcgcagcagctggttgtcgaagccgctgtactggccggtgggggtgatgcacacgttgggcggggcgcccgacagcgtccccaccgtcaacacccccggggtgcccagacccaacgtgtcgatgcgcaccgaactcagcggctcgacggtgggcgtcgtgtgctcgtcgggctggctcatggagccgccgcgggtcaggttctcgggcagcacagccgcgcttttcgggccggccggcgcgcactggttccggtcggccgccgccggcggggccagcagcgccgacgacccgcacaccatcagcacggtcgcggtcagtgcgagtagctttccccggcgcgtgccgcgccggcccacgggcaaattcatcactgccaccgtatcgactggtcggcggcgcggcccgcccagagccggtgctacagggccagcgacgccccgccgcagatggtgtccgcgtcggccagcaccggcagcgggccggcaacgacgcggccggcatcgtcgggcggcgtaaacacccggcggcgaaacagctcgcccagcatcgtctgggccatccggtaggagcgctcgacgcacgccgcgcgcgccgcttcgggatcgcgccggtgaatggccgacgtctcgtcctcgtagaacggcagcaggtcgtcgcgaccgccctgataggtggtccagaacaggcggggaatcaggttctgtgaggcgcggatggtcgcgtgcagccccggtccggcgtattcgtcgttgacggtgcgccggtagtcggcggcgatgtcggtgaacgcgcgcgaatccttggcggtgcgcagcgagcgcagcagcgtgtcgagctcgccgaggatccgtggggtgggactggtcgccgcgcgggccgacgcgatcccgttgagcagcccgtccagttcgtggtgctcgagcacggtggcttcgtcgaaccgctcgacgaacgcgccgcggtggtagcgggtggacacgatgccgtcgtgctcgagttgcaccaatgcctcttgaatcggcacccggctgactcccaggcccaccgcaatttcattgcggtccacccggtccccggtgcgcagcttcccggtcagcaacaggtgcagaatgtgcgaaacaaccaggtccttttccttgaccccgtatttcttcggcatcttttcgcttcagtctctttcacaccgaacagctctggcgctgagagtttctcacgaattaacgcacgcgttcatgcgtttggccgacgaactcggaaccggacgcgggcgggcacgctcagcggccgtcgcgccatttgcacagcgcctcggcgtcgcggaggtcgtaatacgggccgtcgcaccccaccgtcagcagggtgacgccgaggccgaccagtgcttcggcgttggcgagcagttcggcaccgcccttgaccgccgcggaacgctcgatgcgatccgggtcgcggccgacgtcggcgcagtgccgggcgagcacctccgacttcgccgggtattcctcggcggaggtgaagctgtgccagatgtcggcgtgctgcgcgaccagccgcagcgtcttgcgttccccgccgccgccgatcagcaccgggatgtcgcgggtgggagccggattcagcttggccagccgcgcctcgatccggggcagcgcgccggccaggtcgtccagccggctgccggcggtgccgaattcgtagccgtactcgtcgtagtccttctgcttccagcccgagccgatgcccaggatcagccggccctcactgatgtggtcgacggtgcgcgccatgtcggccagcagctccgggttgcggtaggagttgcaggtcaccagcgcgccgatctggatgcgcgaggtctgttcggcccaggcgccgagcatcgtccagcactcgaaatgcgcgccgtccggatcgccgtagagggggaagaagtggtcccagttgaaggcgatgtcgacgccgatgtcctcgcaacggcgcaccgcgtcgcggatctggttgtactgcggggtgtgttggggctgtaactgcacaccgatacggatggggtgggtcataacgtccaccgtaggctcagcgcgcgtcgagcaccccacgcaggatgtcgatcagcgcgcgcggctggtcgctttgcacggagtgccccgagttcgccaccacgtgcgcggtgcggaaatgctttgcgcgacggctcagctcggccgcgtcctcgtcgctgacgaagcccgaggaaccgccgcggaccagggtgaccggcgcggacagggcgtcgacgtccgcccacaggccgtcgaagtccgggaatttgcggatggcgtcgtagcgccacgtccatttgccgttgtccagcttgcgcgagttgtggaacaccccgcggcgcagcgccttcacctcgcggtgcggcgctgcggcgatcgtcaggtccagcatggcctggaagctgtcgaactcgcgttcgccgtgcatcagcgccaccgtgccctgctgctccttggtcatctcggaatgccgttgcagcgccgagggggtgacgtcgatcagcaccagttccttgaccagatcgggtgcgacggcgcccagccggatcgcggtcaacccgcccagcgacatgccgacgacgaggtcggcgccggcggcgtgctcgcgcagcatcggcagtagggcgtcggcgttcagctgcggcgagtagtcgccgtccgcgcgccaggcggagtgtccgtgtccgggaaggtcgaccgccagcgcgggctcgccgacgccgacgatcaccgtgtcccaggtgtgcgcgttttgcccgccgccgtgcacgaacacgatgcgggcatcggtgctgccccagcgcagagcgctgactttggcgtcgccgctgcccgattcgacccgggcgacctcgggcaggggaccggataccccggcctgctcggcgttttcgtgcaacagcgcgaattcggacaggcccgccagttcgtcctcagatacgtcggtcacgttctcgaccctagccccggtgtctacaggacgtagcggcggcgaatgccgcggaagcgttcccacatcgcgtcggcgcgctgcgacggcgtcaccatcacggtgtctttcggcagggcgtcgagcagctcctcgtgcccgaccacccgggtgtccagcacggcgggttcgccctccagcatgtgccggtaggtcaggttgccgcgctcgaaaccctgggtgtccagccagttgtgcacgccgggatcgcgatgggccatgaccagccggatgcgtccgtcgccgtcgacggtggtgcggctcggtgtgtagctgaccgggcggtacaggtagtccatgctgttgaagaagacgcccatgttggtgaacatccacaatccggggtgggcgtcgaattcgacgatcagcgcctcgtcgggcgccagttcccagtacatgttggcggcggcccggccgcgcttgccgtcggcgtcggtcgcggcggccctggggaaggtgttcgggctctcggcgtcgaccccgccgtggcggaacgggtattccggccagtcctggctgaaccggtattccagacagtccgacatcagcccggtgacgaaatcgcccgcccactgcatcgcctcgaccatttcgccgggcgtgggcaacggtttggggacggccatgtcgacgcgttcgatgcgcagctgcgccggggtttcgtcccagcggtcgaaaccctggcggatgaacagttttcgggattcgggcgtggtgggcagccagttgtgcccgcgctcggctccgccgacgtacagctcgaagcggccgtcggcgccgacgcggagttgctggccgaagaggttggcctgcggtgcgtcgccgaagggttcatgcagcacaccctctccgggcgtgcgccgtccctgcacggtgacgttgaagaagcgcgaggtgccgcgggtgccggtgatccggtaggtggaccgcccgtcgatccacgcctgctggtaggtgaagtcggcgcagtcgccgcccagcttgcgggtggggccgcagaaactgtgcagcacagggtaattggcgtcgcgggtctccagggccagatcgaaggcctgcccgaggttttgggtcaggaaccggaaggcgtcgacccgatgcggtccggaggccgggttgtggtctttgaaggctcgctcgcccgcgcgttgcagccgggcgcagaattcggtccacgccgcccgcagcgccgcgtcgtgcgggccgtcaccgaaggccatgttcacccacccagcttgtccagcatcgcgccgacgacatcgcaagcgcgccgggcggattcgagccggccctcccgctcgatgcgggggccgatgagttccaggtcgaagccgtgggcgtagcccgccgcgagcgcctgcgcgacgaacgcctcgatcgggatggcgccgtcgccgggcacggctcggcccggcagcgcgcggtcgccgagcacgtagtcgctcaactggatgagcgcggtgcgcggcagcgcccgcggcagctgcgcctcgaaatccccttcggcccaacagtggaacaggtcgatgcagattcccaggtcgctcatctcggccagggcgacggtgtcgcgcaacgtgtgcgcgatgtggatgtcggcgtacaggctggacgcgttctcgaccgccagtaccacgcccgccgccttcgcccgcacggcgcacggcgcgaccatggcggcgaaccgctcggcggcctgcggccaggtgagcccggtacggcccccggtgagcaggtagacggtgtgcgcgccgacgctcgcggcggcgtcgatgaccgcaatcagcgcctcccgggcagcgccggggtcgctggtcaggtggccgccggcgaacaggtggtacaccgcttcgacggtgtagtcgttgcgccgcaacagcattgggaattgcggatcgagcagctggttgtccaggatgctcagccgggacaccccgagcgccgcccaatgtgcttgcagctcggccggcggcgcgccgtagaacgtgacgttgtgcacggacagccgtttgtgtgcgcccgtcatctcagccccggttttcgatcgggacgccgaaccgttcccggaacggccggaattcggcgtgcagcgcgtcgaggtcctcgccgatatcggtcagcaattgcgtggaatagcggaattttccgtaccggtcgccggggttgtcggccaggtaggcccgcatcgccgactcggcctcggccgtgagctcgcgcccgcagaacgcgtaataacgccgcacggccccaacatgatcggcgatgaagtcggtgtagcgcaggtgcaggatgcgcggatcgtcgaccaggggattggtcatcgtgttggcgatgctggcccgggtcatctcgaggtgcttcttcgcctctgcgtgcaggtcgaccggcccgaccatgccctcggcgatgtcggccatcatcatggtgcgcgacgcggcgacctggacggggtcgcggtgcagccacaccatccgcgcatcggggtaggtgtcgaacagctccttgagccgaaacccatgaaagcccttcagcacccaatactttcgcggcctgttgtattgcagctgttgcagcatcgccttgtgcagccggtactgcgcggccgggtcggtgggcaggccggcaaccagcgactgcatcggcacccgccaccacgcggtgggcgtcatcacccggaagtcgaacgcccaggtgcgttcgtcttcgggcaggccgtcgcccagcatgtcgttgtaggggtggctgtgcagccacttcggcatcttcgcgttgatctcacgccagtcggcgtccgcccgcgcccggcggtcgtcgtcgggccccgccagccccggcggcggcgacgggtacatcacctcccagaaccgcaacgcccgcgcgtgcgggtcgaccgacatcagcgcgtgcataagcgttgtgcccgaacgaggttcaccggtgacgaacatcggcgcgtcgatcacctcggccccgatcgggtagcggttgcggtcctcgatgagttccaggcgggaggtcagcagccagcgacacacctgcgcggcttcgaagcggccgtcggcgtccagccccagggcgttcaggtgttcgacggcgacggtgaagcgttgcggcaacgtcggatcgccgtagtcgtgcagcccggtctccgcctcggcggccgcgagcatctcggcggcgtccaaaagcgttgtcacgacccgtctccgcacagccgcatgagttcgtcctcggtggcccgcacgttggccgccgagctctgcgcgtggctcaggccggccatggcgccgtagtcgaggatcttgggtacccgcagcccggcgtccacgtagctcttgacgatcttggcgacctgcttcggtgtgccgtgcgggacgaccgccaacaccatctcgggtcgcaccctgtgcaggaactccacgatgcggtccctgcccagtgccgccgggtcgatgtcctggaatccgcgccagccatcgcccatcgggtgttcaaacccgaactcgcccagggtcttcgccgacacctgcagcaggaacgccttgaccaggggagcgcgcaggatctcggcgagggcgtcgtcgtcctccccgatcaggcacacttggatgaagcagggggtgatcgccatcggatcgcgcccggcacgctcggcggaaacccttaccgcgccgagcatctgggcatagtgctcgggtgtccacgccccggccggccaccatccgtcggcgtaccggccggcgatgtcgagcatccgggggccgctggcgccgatccagatcggcggcagccggccgtggtagggctcggtgtccaggcgggcctggtgcagcgagtagaactcgccgtcgaagtcgaccgggccgtcggtgtcccagagcagccggatcacccgcagggcttcctcgaagcggctgacgggacgggcgaaatcgaagccgtagggcacggtgttttcgctttcgccgctgcccaggccgagaatgaagcgacccttggagaggtggtcgagggtcaatgcggtctgcgcgagcagggcgggatggcggcgcacggtgtcgaccacggcgctgaccagcggcgcccgctcggtcagcactgccaccgcagccgcgaccgcgagcccgtccaggtgccggtgcggcgagggggaggccgtggccagatcggtgaactcgggcgcccagatcgagtcgggccagaagctgaccatgtggtcgggcagccagacagagtggtagcgcccgctgtcgaactcgtcgagccgggacaggtcgaggggcagcgtggtgcgcaggaacgccgcgggctgaacggtcatcgagagatgatgctaagcacctgcacagcgttctgtcgatgaatcggctccagcgaccgcgggcgtaacgccgtggcgaaatccggccgggaaaatcgccgtggcgttacgcccgcggatcgacgaggctgctagccgccgatgatgaactcttcgagctgggtgcgcgcgacgtcgtcgggcagctgctgcggcgggctcttcatcaggtacgccgacgccgggatcaccgggccgccgatgccgcggtccttggcgatcttggccgcccgcaccgcgtcgatgatgacgcccgcggagttcggcgagtcccacacctcgagcttgtactccaggttcagcggcacgtcaccgaaggcccggccttccagccggacgtaggcccacttgcggtcgtcgagccagctgacgtggtcggacggaccgatgtgcacgtccttggtcttgaactcgcgctgcaggttgctggtgacggcctgggtcttggagatcttcttggactccagccgctcccgctcgagcatgttgaggaagtccatgttgccaccgacgttgagctgcatggtgcggtccagctgcacgccgcggtcctcgaacagcttggccatcacccggtgggtgatggtcgcgccgatctggctcttgatgtcgtcgccgacgatcggcacgccggcgtcggtgaacttcttggcccacaccgggtccgaggcgatgaacaccggcagcgcgttgacgaacgccacaccggcgtcgatggcgcactgggcgtagaacttgtcggcctcctccgaacccaccggcaggtaggacaccagcacgtcgaccttggcctccttgagcgcctggaccacgtcgaccggctcggcgtcggacacctcgatggtgtcggcgtagtacttgccgatgccgtccagcgtcgggccgcgctgcaccgtgacgttggtgggcggcacgtcggcgatcttgatggtgttgttctccgacgcgaagatcgcctcggacaggtcgaagccgaccttcttggcgtccacgtcgaacgcggcgacgaacttcacgtcgcggacgtggtactggccgaacttcacgtgcatcaggccgggcacggtgctgttctcgtcggcgtcgaagtagtactgcacgccctggacgagcgaagatgcgcagttaccgacgccgacgatggcgactcgtacctccgactgcgcgtcttccgcctgcggcggttggtgatcactcatacgggcgttctcctaacctctaaccttctgtctgggatgctgggttttcgtaccgggatttacgtttgctcggagaggccgggcatcgcccgctccgcagcaatgagctcgttgagccacttgacttcgcgctcactggactcgagccccaattggtgaagttggcgggtgtagcggtcgaacgagctactggcccgcgccactgcttcgcgcagaccttcccgcctttcctcgacctggcggcggcgaccttccagaatgcgcatccgcgcctctgccggagtccggttgaagaaggccaggtgtaccccgaagccgtcgtcggtgtagttgtgggggccggtgtcggccaccagctcaccgaagcgccgacggccctcgtcggtcagctggtagacgcggcgggcccgccggacaggcgtcccggccggcgcggcgtcctcggcgatcaacccttcggcctgcatgcgccgcagggcggggtagagcgaaccgtacgaaaacgcccggaacgcaccgagtaaaccggtcagccgtttgcgtaactcgtagccgtgcatgggcgactcgatcagcagacccaggatggcgagctccagcaatcgaatcaccccctcgaaaaggatttgcgtggcttgttacgacggtccgacacctcgcgcaatcgtatcgtctcgatatattagccacaacaccacttgctgttggcttgcagttcgtcacaccggccgggccgcgggagccgccgttacgtgggcaaattcatctgcttgacggtgccgtcaccggtgaaggcgatgtagccgccgccgtagtcgctggagacgtacaccgatagcgagagcgcgccgggggtcgtcgggtccgtcgccggttcgacgatcaggtagctggttttgacgtcggacggtttcatccgcagggtttcgggcgcgccgcgcatgatgcccaccgcggcggtgacgtcgaatttgctcaggtccaccgggacgggaccgtccgaggagctcttggccgagctggtcggatcgccccagccgccgcggtaggtgtaggccagcacccggcggtcgtcggagggatccggacggtccagcgccgcgtaggtcgggtagatcaccagccggtagccgagggtgctgccgaaccgtttgcgcatctgttcgagcagcccggtcagcccgccgaccgagtgcagctgggtcggcggcgtgagcaccacggcgttgacgccgtcgggtttggcgccggggtcgctggtgaagtccagcggcgagctggtgttgccgtacaacccccagccgatgccgatgccgagcagcaccgacaccacgaaggcggcggccagggtcccccagccgcgcacccgccccgacggcggtgacgggtcgagggccggcggctgcggcccggtttgcagatcgcacaccagggtctgcaggtcgcccagcgtcaccgccttggtggccgcgctgacgcgttcccgatgttcctcggcggacagctcgccgtcggtgagcgcgttgtcgaggatggtgcaggtgctttgccggtcgctgtccttggcgcgggtgctcgcccggccggacggcggcgcggtgccggcgggtggtgtcccgagccatttcgccacggggacgatcgtagaagtccggccgcggttcggcgggcgaaccaccgtcgggcagcggggcgcgaccgccacggttttggttgcgtatccccggtcgggatggcgacgtactctggtgggcgtgcgactgcagcgacaggtggtggattacgcgctccggcggcgctccctgctggccgaggtgtactccggccgcaccggcgtgtccgaggtgtgcgacgcgaacccttatctgctgcgcgccgccaagtttcacgggaaacccagccagatcatgtgccccatctgccgcaaggagcagctgacgctggtgtcgtgggtgttcggcgaacacctgggccccgtgtcgggctcggcgcgcaccgccgaggagctggtgatgctggcaacccgtttcgaggagttcgcggtccacgtggtggaggtctgccgaacctgcagctggaatcacctcgtcaagtcatatgtgctcggtgcggcgcgcccggcgcctccgccccggggcacccggacgactacgcggacggcgcgcaacggcgcccgcacggccactgaatgagctcgaataacgaaggacgccacagccagtcgtccggtgatcaacgtgggcccgcggccgagcagggtgccggcgaacgccgggagacggcgcgtccggacgccgacccgcagcggcgccacggcccgtcgacgtccagccgtcgccggcaggccccgcccgacgatcggctcaccacgatcctgccgccggtcgacgacgaccgggcgccccggcgctccgacccgatcgaggaggtcaaggccgcgctggcgggtccgccgtcgacgccgttgcgccgcgacgcgctcgacgaggtcaaggccgccctggacagccgggggcctgcgtcgggtcgccagcagcgcgccggcctcggcggccgcccgcccgcggggcccccgccgccgcctccgagccgcggctggtccggtgggcccggcggcccgggcggccgggggagcggaccgtggcgcgactggagctggacccagcagatcaactggctgtgggtgcgccgcgccgcctacctgtgcgcggcggtgctggtgttgttgccgatcgtcacgttcgcgatggcctacttcatcgtcgacatccccaagccgggtgaccttcgcaccaaccaggtttcgacgatcctggccagcgacggctcggagatcgcgaaactcattccgccggaaggcaatcgggtcgacgtcaatctcaaccaggtgcccgtgcacgtccgccaggcggtgatcgcggccgaagaccgcaacttctactccaacccgggcttcgacttcagcggtttcgcgcgcgcggtgaacaacaacctgttcggcaacggggatctgcagggcgggtcgacgatcacccagcagtatgtgaagaacgcgctggtcggttcggcgcagcacggggtcagcggcctgatgcgcaaggccaaggaattggtcatcgccaccaagatgtccggcgagtggtccaaagacgaagtgctgcagtcttatctgaacatcatctatttcggccggggcgcctacggcatctcggccgccgccaaggcgtatttcgacaagcccgtcgagcagctcaccgtgtccgagggtgcgctgctggcggcgctgatccgccggccgtccaccctggacccggccgtcgatcccaagggcgcgctggcgcgctggaactgggtgctcgacggcatggtggagaccaaggcgctgcccgccaaggaccgtgccgcgcaggtcttcccgcagaccgtgccgcccgaccaggcgcgcgcgcagaaccagacgaccgggcccaacggcctgatcgagcgtcaggtgaccaaggagctgatggagctcttcaacatcgacgagcggacgctgaacacgcagggcctgcaggtcaccaccaccatcgaccccaaggcccagcaggccgccgagaaggcggtgtcgaaataccttgacgggcaagaccccgacatgcgcgcggcggtggtgtcggtggatccgcacgacggcgccatccgcgcctactacggcggtagcgacgccaacggtttcgacttcgcccaggcgggattgcagaccggctcgtcgttcaaggtgttctgcctgatcgccgcgcttgagcagggcatcggcctgggctaccaggtggacagctcgccgctgacggtcgacggcatcaagatcaccaacgtcgagggcgagagctgcgggacgtgcaacatcgcgcaggcgctcaagatgtcgttgaacacctcctattaccggctgatgctcaaactcaagggcgggccgcaggccgtggccgatgccgcgcatcaggcaggcgttgccacgagttttcccggcgtggaccacacgctgtccgaggacggcaagggcgggccgccgaacaacggaattgtgctgggccagtaccaaacccgggtgatcgacatggcctcggcgtacgccacgctggccgcctcgggcgtctaccaccggccgcatttcgtgcagaaggtggtcaactcggacggtcaggtgctcttcgacgccggcaagtccgacaacaacggcgagcagcggatcccgaaggccgtcgcggacaacgtcaccgcggccatggaaccgatcgcgggctactcgcggggtcacgcgttggccggcggccggccgtcggcggccaagaccggcaccacgcagctcggtgacaccacctccaacaaggacgcctggatggtcggctacacgccgtcgctgtcgacggcggtgtggctgggcacggccaagggcgaccagccgctggtaaccgcttccggcggaccggtttacgggtccgggctgccctcggatatctggaaggccaccatggacggggcgctgaagggcacccccaacgaatcgttcccgaagccggccgaggtcggcggctacgccggtgtgcccgcgccgccgcccccgccgaaggcgccgccgtcggagaccgtcatccaacccaccatcgaagtggcgcccggcatcacgatcccggtcggcccgccgacgacggtcacgctggcgcctgccccgcccgcgggcggcccgccggggggacccgagccgggtggcggtgtaccgccggggccgggcggcggtgttccgccgggtggtccccaagcaccgcctccgccgccgtgaccggcgctgccgagcccagcgccaccatttcaccggggccgctggccgcggatcggcgtagcgccgacaatcgagactgcccgagccgcaacgactttctgggcgccgcgttcgccgaggtgatcggcgggccggtgggccgacacgcgctgatcgggcgggcgcggatcatgaccccgctgcgggtgatgttcttgatcgcgctggtcttcctggcgctcggctggtcgacgaaagcggcctgtctgcaaagcaccggcaccggcaccggcgatcagcgggtggccaactgggacaaccagcgcgcctactacgagttgtgctattccgacacggtgccgctctacggcgcggagttgttgagccagggcaagtttccgtacaagtcgagctggatcgagaccgattccaccggcgcccagcagatccgctacgacggtcagcccgcggtgcgctacatggaatatccggtgctgaccgggatgtatcagtacgtttcgatggcgttggccaagacctacaccgcgctgagcaagctggccccgcttccggtggtcgccgaggtggtgatgttcttcaacatcgccgcgttcgggctggcgctggcctggctggccaccgtgtgggcgagcgcgggcctggccggccggcggatctgggacgcggccctggtggcaggatccccgctgctgatctttcagatcttcaccaacttcgacgcgctggcaacggcattcgccatggccgggttgctggcgtgggcgcggcggcggccggtgctcgccggtgtcctggtcgggctgggcgcggcggccaagctgtacccgctgctgttcctgggtcccatgctgcttctggggatccggaccggacgcctgggcgcctgggcgcgcaccgcggtggcggccgtggcgacctggctgctggtgaatctgcctgtgctggtgttctttccgcgcggctggtcggagttcttccggctcaacacccggcgcgccgaggacatggactcgctgtacaacgtcgtcaagtcgttcaccggctggcggggattcgatccgaagctcggtttctggcagccgccgaccgtgctgaacacggtcgtcgcggtactgttcgtgacctgttgtgcggcaatcgcattcatcgcgctgaccgccccgcgacggccgcgggcgacgcagctggtgttcttggtggtcgccgcgttcctgctgacgaacaaggtgtggagcccgcagttctcgctgtggctggtgccactggccgtgctggcgctgccgcaccggcgggtgctgctggcgtggatgaccgtcgacgcgctggtgtgggtgccgcggatgtactacctgtacggcaacccgaaccgttcgctgcccgagcaagtattcaccaccacggtgctgctgcgcgacatcgcggttatcaccttgtgcgcgttggtgattcgccaaatctaccggccggacgaggatctggtgcggtggggcggacgggtggacgacccggcgggcggaccgttcgaccgcgcacccgacgcgccaccgggctggctgccggactggctgcggccggccggatcgcgccgcgggcaggccgcggagcccgaacccgcgctggccggggcgacatgacgctgatcgccatcccgctgttcccgcgggtcaccacactggatgcggtgggaccttacgaagtgctgcaacggattccgtctgtccaggtcgtgttcgtcgggcagcgccggggcgaggtgcgcaccgagaacgggatgctgggcctggcctgcgacgccaccttcgacgaggtgagcgcaccggacgtggtggtgttccccggcggcatcggcacccggcagctcattcacgacgaggcagtccgggcctggctgcaagcggtgcacccgcacaccagattcaccacctcggtgtgcaccggcgcgctgctgctggccgcggccggtctgctcgacggactcaccgccaccacgcactggcgcgccgccgacctgctcaacggattgggcgcccgctacgtggagcaacgagtcgtcgaacacctgccgcagcgcatcatcaccgcggccggggtgtccagcggcatcgacatggccctgcggctggtggagctgctcgtcgaccgccaggccgcgcaggccgcccagctgctcatcgaatacgacccgcagccgcccttcgactcgggtgcgttcggcaaggccgatgcggcgaccgtggcccgggccgaggaatacctgaccggccggcgctgaggcgattgcccgaccgcgcggatttttctggtcagcccgctatccggtagcctggggcggttgccgacgcaggcgaccctcctgccacggaacgaccgtggccgcttgagaccagaggaggtggtgaggtttccatgcgtccatacgaaatcatggtcattcttgaccccacgctcgacgagcgcaccgttgccccgtccttggagacgttcctcaacgtcgtccgcaaggacggtggatccgtcgaaaaggtcgacatctggggccggcgccggctggcctacgagatcgccaagcacgccgaaggcatctacgtcgtcatcgacctgaaggccgagcccgcgacggtgtccgagctcgaccgccagctcagcctcaacgagtcggtgctgcgcaccaaggtgatgcgcaccgacaagcactaacagtcgtggccgcgccgcgggcccaccgggggaggcacctgcgtaggctcagcgaggacacgctcatgacatccaccaccggagcggcgcggagcagggcggaacgaggaggaaactgtggctggtgacaccactatcaccgttgtcggaaacctgaccgctgaccccgagctgcggttcacgccgtcgggtgccgccgtcgcgaatttcaccgtggcgtcgaccccgcgcatctacgaccgccagagcggggagtggaaggacggcgaggcgctgttcctgcggtgcaacatctggcgggaggccgccgagaacgtcgcggagagcctcacccggggatcccgcgtcattgtcaccggccggctcaagcagcgttcgttcgagacccgggagggcgagaagcgcaccgtggtcgaggtcgaggtcgacgagatcggcccgtcattgcggtatgccaccgccaaggtcaacaaggcctcccgcagcggcggcggcggtggcggcttcggcgggggatcccgccagcagcccgcgccggccagcagcgcacccgccgacgacccgtggggcagtgcgccggcgtcgggctcgttcggcggcggcgacgacgaaccgccgttctaagaagaaactttcagcagtaggaaacggaaagaaagacagacatggccaagtccaacaagcggcgcccggctccggaaaagccggtgaaggcacggaagtgtgtcttctgcgcgaagaaggatcaagcgatcgattacaaggacaccgcgctgctgcgcacttacatcagtgagcgcggcaagatccgtgcgcgtcgcgtcaccggcaattgcgtgcagcaccaacgcgacatcgccatcgcggtgaagaacgcccgcgaggtggcgctgctgcccttcacctcctcggcgcgttaagcaccgaaggccaaccgaaagtacgaaacgatgaagctgattctgacggctgacgtcgaccatcttggcgccgtcggcgacactgtcgaggtcaaggacggctacggccgcaacttcctgctgccgcggggcttggcgatcgtggcctcgcgcggcgcgcagaagcaggccgacgacatccgccgggcccgcgagaccaaggcggtccgcgacctcgaccacgccaacgagttcaagaccgcgatcgaggcgctggggccggtgacgctgccggtgaagacggccggggattccgggaagctgttcggctcggtgaccgccggtgacgtcgtcgcggcgatcaagaaggccggcggccccaacctggacaaacggatcgtgcggctgcccaaggcgcacatcaaggctctcggtacccacccggtggccgtgcacctgcaccccgaggtcgacgtcgaggtcccgctcgaggtcgtcccgcagagctaagcggccggcatttgctcattcccggcggtggccacgatgggccgccgccgggtttcgttgcgctgcgggcttgcgctcgagggccgtccggggcggtcgcggacacggcttctggcgaactatttggggggtccaccggaccggtccgtgttaccgggccgtaacgcagcgaaaatatggcggaaagccaacacgcccgggacggtaacctggcccgacacgccgtagagattcttgtccacacggatttcgtggcgttgtatggccggtatctgcgccgatgtcctcgccctttgcattaatccacaggttctccacaccccgctcaacacaggtgtcgacggatatgcacacaccatgcacagcttcatgaacagcacccccttcacccactagccagcaacgtctaacgtcgtcccggcgccgggcgagcgggtgcgatacggccaagatgtcagcaccttgacctacgctcaatgtcaactgtcgaatgtatgttcggattgcgtggatcaggggaggagggaatccgtggcggtcgtcgatgacttgacgtcgggcatggattcgtcgtcgcccagtgaggatttcgggcgacagccaccgcaggacctggcggccgagcaggccgtgctgggcggcatgctgctgagcaaggacgccatcgccgacgtgttggaacggctgcggcccggcgacttctaccgtcccgcgcaccagaacgtctacgacgcgatcctggacctgtacgggcggggtgagccggccgatgccgtgaccgtcgccgcggagctggaccgccgtaatctgctgcgccgcatcggcggtgcgccgtatctgcacacgctgatctcgacggtgccgaccgcggcgaacgcgggctactacgcgaccatcgtggccgagaaggcgctgttgcgccgcctggtggaggccggcacccgtgtggtgcagtacggctacgcgggcgccgagggcgccgatgtggccgaggtggtcgatcgcgcccaggccgagatctacgaggtggccgagcgccggaccacggaggatttcgttccgctcgaggatctgctgcagccgacgatggacgagatcgacgccatcgcctccaacggcggtgtggcgcgcggcgtgccgaccggtttcaccgaactcgacgaggtgaccaacggcctgcacgccggtcagatgatcatcgtggcggccaggcctggagtgggcaaggcgctggcgttggatacgccgctgccgacgccgaccgggtggacgacgatgggcgatgtcgcggtcggtgacgagttgctcggcgacgacgggcggccgacgcgggtggtagcggccaccgacgtgatgctgggacggccatgctacgaggtcgagttctctgatgggaccgtgatcgtcgccgacgctgcgcatcagtggctgaccgaaacacgcgcatcccgaaagtcggcgcaggcagcggccgttggctacaaccggcacaagaatcagcgcacctttgcggcggtgcgaacgactgccgagatcgccgaaaccctgcgctgccccacccaagaccggcggttgaaccacagcgtggtcaatgcgcgcgcgctcgagctcccggaccgcgaattcctggtgcccccttacacactcggcgcctggctcggggatggcaccagcgccgccgcgcagatcaccgctgccgatcctgaaatcatcatgcggattgaagcggacggcgtcgtcgcggtcccgtcgggatccgccccgtaccgttaccaattgcgtttacctccgggtgctgagcaagcaccgcggcggtgcgtggtgtgtggcaagtcgtttattccccaaaccagccaggtgcggacctgtgggcgttcgtgcggcggtcgcgcgcgcttcatgtccgacccggtgccgagcccgacctgcgttcgctgtggcggaccgtcggcaggaatgcggttgtgcctgaagtgccactccaccgtggggacgttgcaggcgcggttgcgcaccatcggcgtgctcggcaacaagcacattccgacggaatacctgcgggggtccgaggcgcagcggcgtgccttgctcgccggcttgctcgacaccgacggaaccgtgacggtcggcggtgccgtccaattttcggttaccaaccaacggctggcgcgtgatgtcaacgagcttattgtcagcctcggctatcgctgccaaacctcgaccaaacgtgtccagggccgctccgaaacgtcgagcatcgcctacaccctgaccttttccaccgaagataaagtgttcgcgttggagcgaaaggccatcgcgcacaaggagcgccgggccgtaacaggcacctcacgctgtgggtcgcgcttcatcgtggacgtccgcccgatcgagtcggtggccgtgcgctgcgtcgaggtggacaacgacagccacatgtatctggcgagcagggcgatggtgcccacacataactccaccctcggtctcgacttcttgcgatcgtgttcgatcaagcaccggatggccagcgtcatcttctcgctggaaatgagcaagtccgagatcgtgatgcggctgttgtcggcggaggcgaaaatcaaactctccgatatgcgttcgggtcgcatgagcgacgaggactggacgcggttggcgcggcggatgagcgaaatcagcgaggcgccactgtatatcgacgattcgccgaacttgacgatgatggagatccgcgccaaggcgcgccggctccggcagaaagccgatctgcggctggtggtggtcgattacctgcagctgatgtcgtcaggaaagaaagtcgagtcccggcagctcgaggtctccgaattctcccgtcagctcaagcttttggccaaggaactcgaggttcccgtcgtggcaatcagccagctgaaccgcggtcccgagcagcgcaccgacaagaagccgatgctgtccgaccttcgcgagtcgggatcgctggagcaggatgcggacatggtgatcctgctgaatcggcccgacgcgttcgagcgggacgatccgcgtgggggagaggcggatttcattctggccaaacaccgtaacggtccgaccaagacagtgaccgttgcgcatcagctgcatctgtcgcgcttcgccaacatggcgcgctgacgtagattctcaaactccgtgtccaattctcagacgaaatgtccactcgatgtcccattgcacatcccgaatgagacgacccgagagctgctgccgccgcagcagccgcgccaattgtgtgacaacacgtctggcagtcttatctatcttcggcgggatgtggcatcaccgccttccgccacgcccagggcgccagattccgaaaggggtcggttgcgcgaatcgcaagcagagcagcgagattggattccagatctgtcttcgcggtctctctaactgttgtcagccactcgccgtgagaagtgcctttcggccttgtcgtgtcgatggtacgcgagaagcgcgcatagaggcgttgagggcggggcagcagtgtcgggcctatgccgcgtgacaggggcagcagcagatcggcgtcactgcccagccatctgctgactttcttgctgagctgcgcccacgtgccatcgctggtggtgagaatcttgtacatgtcgtcgccaccgacaacggcagccgtgacgatcgggtagttgtgctcgatggcgaggcgtgcgaaccctgcccggtcaccccactgcagtgtgttgagttggtcttttcccttaccgatttctcgtgcaccaccgggaaataccaggatgggctcgttagcgcgcatgagttcggcggtgccttcgcgggtgccgacgatgcctccaccggcggccagcacatcggccgccaagcctgcgaaccggccgaaccgacgatccatcaacgcacgtactcgccggcccaggtgccgctgaacctcgtagagcagcagcaggatttcactcgatggtgtatagctgtgattggccaccaacaggaatctgccgtctgaaggcaggttctccaacccgtcaacatagggcttgtagacggggcgtacccgatcccattggcgtgccaatccgaagatggcacgttcgatcgcggcttgtcggcgcgtgcgctggtcatcagccgttgccgagagtagttgtcttgctggtgaattcatctcttcgtccctaaatacgggggcttatcgttgcgtcctttgtgaaagccgttgggggagcaggtgatcgaggcgtctgtccacatcagctggcccgcggtcgagtgaacactatgccgacgtgtcccggtcgcagtcgacaagcggacaagggcaggaattcgacgcccatgcgcggatcggcggctttgccgagggcgatgaacgccgagcggctgtaggcgcgcagcgcgctgatgtacgcgtcgtgcatgacgtgtttcaacgacggccgcaccagcgcgagtacggccgcgaacggcgccaagatcagcggtgtgagcaagagctgcaccgaccgcggccggggcaggtcgatcaccaggaagcgcttgccggcgtgggtggcttcggcgatcgcgcgcaccgcagtcgctggcggcaaatggtggaatgcctgagcgaataccaccaagtcgtagctgtcgtcgggcgcgtcgatggcggtggcgtcgacgacctgggttcgcgcccggggatcagcacccaggggaccggcagcaatgttggccaccgaggtcgggtccaggtcgctgacggtgaccgtcgcggtgggatgggacgtgaggatctcggcggagagcttgccgtgcccggcgcccagctccagaatgcgcgggttggcgatgtcggcaacgatgtccagggccgtgcgggcattcctttcgtgataccccgcacgggtgcccatccgatccagcgctgcgaccacggtctgcttgacctcgtcggggatgtcgtaacggtcggtgtactccaacttctcggtctgcaaccgccgatcgagccaggacgcatccggaccacccctgggcatcgacgcgatcgccggatccactgttagtgcctcgctcatcgcaccctctccatattcagccgagctaatccgacagccacgacggtagcagacgaactagttcgtttggtaggtggtttatgtgagaaccgccaccgagctgcgcggccagatcttgcaggctgccggggcagagttcgcccagtatggattggccggcgcgcgcatcgaccgcatcgcgcgcgtcgcccaggccagcaaggaacgcctctacgcccacttccgcgacaaggaaactctgttccgcgaggtggtggccgccggcaaccgcgagttcttcagcgcggtcacgttgcgccccgacgctgttcccgacttcgtcggcggcatctacgatctggcgcgcgagcacccggaacaccaccgcatgatcagctgggcccagctggagggcatcgcactcgacgaaccccacgccgagggccaacctgccttcgctcagcatgtcgcggccatcgaagccgcccaggccgacggccacgtcgacggcgcctggcagcccgacgacctgctgattgtgctctttggcatcgcactggcatgggccaactcaccgcaccccgatgccgcgaccaatgaccccgacgctaacgcgcgccgccgcgccgccgccgtcgaggccgcccgccgtatcatcgccccatcgaagtagccggctgtggcgtctggaacccattgccacccagcgcttctcggcttcagcccgcaggcagagaacacgactcaacaggtgccgcgacgttgacgcgtgacggccagcagtgtagtacatgatcgcgcagtttgtcggacgaccaagcgcaaattgaattggctggcgcgcaacattttagaggatcttcagtacttagtcgcagataagtcctgaaaccggcgtcactgtgacgctcgagtatgggccgccgagatcaggcgtcacgcttagccggcatcgacgggcagtggttcgccggtaatgcggctgatagtccttgtcgcgcaacgtctttactgccctcgcagagccactcagatcgacgtcaacgtgtttcgccgcggattgcgcggcgcataccgcacctcgacgggcttgccgtcatagaacatccagttggtcgcccgagtcgagctcaacttaccggtaaacggtcggccctgctcatttctcgtgtcgtccgtacctgtccactggggcgaacggcttctgtcgctattgctctacaggcagggctcggctgaacctgccgctggtcgtgatcggaatcgatccaccttatcgaggtcatcggtgacgaaagcctcgcgactggccgcgtgtccctccggccccggttggtgcgcctagatttcaggtgaatggcggcgccattcacctcatcgaatttcgattcatcgccccgctttggcgggctcgtgatgcgccctctttttcgcatggctcgagcagcaatgcccgagatcgcaatggaatcggtcactgcactcatgcgaacaaaaaatcgacgcggccgggagccaatccggatcggacaggtcacgccctcggtcattcggatcgaacgcgtggccgcaatgtgcgcaggtcctgaccttggtagccatatcgctcagggtacgcgcgacaccgccaaatcggcgctgtttttcggcgcgacggcggcaatcgacgtcgcgaaaaattaacgatatcgaatttgaattaacgatatcgaatttgaaaggcgccgctacgccagcgaattgctttgcaaaactaactcacttatggacggtgtgtcggtatcgctgcagcccggtactcggagcgcggttggtgctcagtgaaccccgacttgcggttgatctcaacagcgaaaacccgtgtagcacaatgcatccatgcctgcaactccaacggacgcctgcccactgaattagcgctgcaccggcgtcactgtctacgatgttgagccgtcgctgtgtgccggcagcacgcgaccagtccgtcctggcgtcaccgccacctctagcaaactggtcgctgcagtgcgacaaggcgtgcgggcgggcgatcggcggcaacttggtagcgcgccgcaggaattaacgcggcagtaatcgcgttgcgcttgcggtggcgcacacgattacatgccttgatgtcggcctgtcgagctttggtaatcgggaggggcggtcgtgacgtttctcaagcggggatgggttctgttggtggtggtcgtggcgttgatcgtcggcggggttgcggtggtccgactcaacggcgtgttccccgggcccggtctgcccaagcccgatccgcgggatgcgaccccgccgtatgcctccaagacggccatctacgaaatcctgggaccgcccgggacgacgggcgtcgtcaactggatggacgcggagtcactgccgcagcgggccagtttcaccacgttgccgtggtcgaagacgatcgtggcggagatgcccggcatcttcgcctatgtcgtggcccagggcgatggcccgttcatcggctgccggatcaccgttgacggcaggccggtcgatcagcaggagtcccacaaccgggacgcgcaggtttcctgcttggacaagtccgcgtgagcgacgacatgagcgacacggacgaaatccccgtcgcgcaccgcacccgcgtcgaacacaaaccccgtctggcacgcacgattcgggtgctggcgctgccgatcgtgctgggctggttggtgctcgcggtcggggtcaatgtctttgtcccgcagttggagaaggtggccgaggaggtctcggtgccgctgtcgccgtcggacgcgccgtcggtgaccgggatgaagcacatcggggagaagttcaaggagtacgactccgacaacctcgtgctggtgaccctggtcggggacaaacccctcggcgaggacgcgcaccgcttctacgacggcttggtcgaaaagctcaagcgggacccgcatgtcgagcacgcgctgaacttctgggggcagcgcttcacgtcctcgggcgtggagagctacgaccacaagtccgcctacgtccaagtcaacctgcgcggtgatcagggcggtgccgtcggcgacaagtcggtggccgcgattcgcaaaatcgtcgcggattccaagccgccggcgggggtgaaggcctatgtggccggtcagggcgccctgaccgccgacacgatcgtcgtcggcgacgcgagcctggccaagatgacgatcatcaccatcatcatcatcgcgatcatgctgatgttcgtgtaccggtccatcggcacggtgttgctgacgatggtcatcctgttcgtcgggctggcgaccgggcgaggcgtggtggcgctgctgggcgaaaccggcatcatggggctctcgacgttcgccgtaaacctgttgacggcgttggccatcgcggcgggcaccgactacgcgatcttcatggtcggccgctatcaggagggccgcgaacgcgggctggaccgggaagccgcctactacgacaccttcgccggcgtcaccaaggtggtgctgggctccggcctgacgatcgtcggggcgctcgcgtgtctgaagttcacccggctgccctacttcagctcgctggcgtttccgtgcgcggtcggtctgctcgtggtggtggccgccggggtgacactgacgcccgcgctgatcgcgctggcaagcggcttcggcctgttcgacccgaagcgcaagttcaactacacgcggtggcgccgcttggcgacggccatcgtgcggtggcccgcacccattctggccacctcggtcatcctggccatcgtcggcgccatcggtttgatgggcttcaccccgcgctacaacgacctctactacctaccgcagagcgcgtcgtcggtgcaggcgtacaacgcggccgatcggcacttcacccaggcccggttgaatccggacctgctgatgatcgaatcggaccacgatctgcgcaatccccgggacatgctggtgctggacaaggttgccggtgccatcttccgggtgcccggaatcgaacgggtgcaaagcatcacccggccgttggggccgccgattcaagacggatcggtcccgtttcagctcagcgtgcaaagcgcgccgatccgcagcaacctcgattatctgaaggcccgggtcggcgacatcaagaagatcaccgggttcctcgacacccagatcgccctgctggagcgccagtacgcggtgacccagaagctcgcgaacgccgcggacgacagctcgaaaaccaccggggagacggcggccatcaccgaccagatccgggaccacatcgcggatttcgacgacttctggagaccgattcgcagctacttctactgggagaagcactgctatgacatcccgatctgctggtcgctgcgcagcctgttcgacgccctggacgggttcgatcagctggccgaaaagttccacgccctcaccagcgacctgaccgacacggccaaggccacgcgcgaactgctggcgatcattccggagaacatcgccgtgtcgaagtcgatccgggatacgacgctgaccatctacagctcgttcgacagcctgatcgcccagttcgaccggctgaccgacaccaacgccgtgatgggcaagtcgttcaacgactctcaggtggagagcctgttctacctgccgcccgagatcttccagaaccccgacttccagctgggtctgagcttgatggtgtcaccggacggcaaggccgcccggttcatcatcacccacgcgacggatccggcgacggtcaagggcatcgcgtccgtcgatcaggagcggcaagcggccaaggaggcgctgaagctgacctcgctggagaacgccgacatctatctcggcggcacggccgcaacgttttacgacatcgccaacggcgccaagtacgacctgatgatcgcggcggtggcctcgatcgtgctcatcttcatcatcatggtgatcgtcacccgcgcgttggtcgccgcgggcgtcatcgtcggcacgatcgtgctgtcgctgggcgccgccttcgggttctcgacgctgatctggcagcacctcgccgatttccagttgcactgggtggcaaccgaattcgcgctgatcgtgctgctggcggtggggtcggactacaacctgatgctggtgtcgcggatcgaggaggagatcggcgccggcctgaaaaccggactcatccgcggcatgggagtcaccggcccggtggtgaccgccgcgggcgtggtgttcgccgtgaccatgggcgcgatgatcaccagcgatctgcgggcgatcggccaattcggcaccacgatcggcatcggcctgttgttcgacaccttcgtcgtccgatccctcatcacgccctcgatcatgacggcgatgggtcgctggttctggtggccgaagcgggtacgggtgcgtccggccagccagatgcttcgctccgtggggccgcggccgctggttcgcgctctgctgcaccagccgcgccacgcggtcccgcccccaccgacgacatagccccggccgggggtcagcgcggccgaccgcgcaggccgccgtcgacgaccttgacgcgtttggcaacaggtaggccagcgcgcgcgacaacccttatgccgcagcacgattactgtgatatgcggccgcttacgagtagctgctgtccgctgacgccgccggcgggttcgccggttactcgcataacacctccggcagcggccccgggggactacattgttgcgatcggtagggggccggcgaaaggacgctatcgatatgagcatcgacaacgaatcgacggcgtcgcgccagttcgtcgcctccgctgccgccttctcctccaagtggaccaagggaattcgctactggcaggcgggctacaccgcggtcttcatcgccttcgtcgtgttcatcgcggtgaagatgttgggcaccttgaagatcgtcaatctccgcacgccgcacatcggcgccgcggccgtctacgccctgccgatcgggctggttgtggtgggcgcggcgatcggtggctacctgtggtggcggtcgcgccgcacctacctgctcaccgtcgccggcgacaggctcaccatcggccggcggcgccccgaggtctatccactggctgacgcgcagctgggcctgtgggtggacaacggcgtcgcccttcatctgcactccggccgacgccgcttcgtgttgggcggtcgagaccgtcgcatcgggccggggacaccgcttgccgcgccgccggtcccgctcgtcgacgcatcgctcggcgcggccgacttcgacgaattgcttgccctgggcggctggtcggcggcacgcgggcccgccaccggggaaccgattcggtgtctgctgttccccaacccgttggagacccaacggatgggttcgttcgcgctgcggaagaagcaacgcctgatccggtcgctctcgcaaccgcaactgctcatcgacctggacgccgacagtatccgggtcatcgacccgaacaacgacgccgtcatggcgatgacctgggtggcacgggtgacggccaccccggccacctaccggctctccgccggacatgccgtcccgtccgcccagcatatcgcgagcgacgctgtgggccagtacttttcgaccatgccggcgctacggatcgacattgccggcatgccacccctgaccgtcggctgtcgcgccttcgacgggctcaagcagcgttgctcgtggtcgccggacgttcccaccacccacgagcccccgacctatgcggtctcggcggccgactggcaaagcctcatcgaaaagctcggcctggccgcccgcctggcggacaccgcctaggacggcacccggcggtcagttggtggccgaggcgtagcccgctcgtgaccttctcgcgacggcggccaaggacgctcatcaggtgacggtaattgcggccatcggcgcgctcgcgacggcggccttcctcggctaccacgtcggccgccgcgcgggctcgcggcggccgacctgggcgaagcgcaccagcaggcccgcgttgggcaggctggcgatcaccctgatcgcgatgatcgcggcgcgtcggatccagcagcgcctccgggccgagcgcgggcgcgccgcgacccacgcatcgagactggttgcaccgctcggtattttgcgtgcgggcgtaacgcggatccggtgctactagataagaggaacacaacgagatggctgcactgcaggacaaggtggcgttggtgaccggggcgtcgtcgggactgggcgccgaaaccgccaaactgttctcgagccagggcgcaacggttttcggcatcggccgcgacaccgtccgcctggccgaggtgtttgccggcatcgaacgcggcggattcgcgtcggtggacatcgcctcaccgcaggcctgcaccgaggcggtcgcgcagtgcgtgcgtgatttcggcggactggacgtgctcgtcaacgtcgccgggatacaccggatgcgccggacggaatcgatgaccgacgaggactgggagcacgacctcgcggtgaacctgaacgggccgttcttcctgtgcagggcggcgctgccggagctgctggaacgcggcggcaacatcgtcaacgtcagctccatcgccggcgtcgagggacaggcgtattcggccggctactgcgcggccaagcatggattgatcggtctaacccgcgcgctggcagtggaatacaccgcggaccggctgcgcgtcaatgcggtatgcccgggtggcatgctcaccccgcagatcgaacggttcagcgcgccggacgatccgaactacgacctgatcctgcgcaccgccgcaccgcgcggcatgatgcgaccgctcgacgtcgcgaatgtgatcgcgttcctcgccagcgacgcggccgctgccgtgcacggcgccgtgtatcgggtggacaacggcaagggcgccggctgacgggcccgacgccggcatcgtgcgtgcgctaccagagcagcgtgtcgaacatcagcgccgtgccggcggcggtgaacgcctgatacagcggctccatgcgggcgagccgcgcgggtacccgggccagccggcgctggccgacgaagcgatagagccaatagaccgccagggcggcaaatcccagcgcccccaaccagtttgccgcagccacccaggagaatccgccggcgcctggggacgccggatgctcgggtagccgcatgccgggcatgttcgcgcccaccgaatccgacgccgagtgcccatgcgcgtgcgcaaccgtcgtgccgctgctcatcaacgcatacatccacgccatcgccgccatcatcgccgcgtaatagcaggttttgagtcgctctcgggattccgccgatgcccgcacggccaagaacacgaaccaagcccccgccagcaggaaaaagagcgtcggcgcaaccgcgggaaggcccaggccgacacgccacaccatcaggatcatcgccgccgacatcgccaggtgcagcaggtgattgaccgcgcagctccaccgatcacgttgcgacacagcaagataggtgtacgccgcaaggctcgcaccgaacagcgcggtgacggcccagcgcaccgtgagctcgccgatcatggcacgccacatcgtgacctggcgaagaccgcccgcggctgcgctgcgtccatggcgccccagtagccctgcggggtatcgaaaccaacgggggatcgggtgtcggcgaacgggccgaattggataacggttccagcacgtttcggccaaccctcgacacgtcgcgtcgcaccgcgtttggcgtgattgacaattcggggcatgacgcaatcgcggaagtccgacgatggcgcgtgaaatctcgcggcagacgtttctgcgcggagcagtgggagcgttggcggccggcgcggtgctctcggcgcaccccgggttggagccgatccgcgaccctcgggctgggaaggtctgtcgaccgccctcggcgggaaggtgctgctcccggacagcccccaattcgccggggccaagcaagttttcaacaccaactacaacggctccacgcccgctgcggtcgtcacgccgacgtcggcggcggacgtgcagaaggcgatggcgttcgccgccgcccacaacctcaaggtcgttccgcgcagcggcgggcactcctataccggcgcgtccaccgcgaacgggactatggtgctcgacctgcgtcaactgcccggcgacgccaacttcgacgccgctacgggacaggtcaccgtgacaccggccaccagtctctacaccatgcaccgaaccctggcggccgtcggccggggcgtcccgacggggacctgcccgtcggtcggcgccgcaggtcacgcgctgggcggcgggatgggcgctcagtcgcggcatgcgggcctgctctgcgatcagttgacgtcggcgtcggtggtgctgcccagcggccaggcggtcaccgcgtccgccgccagcaaccccgacctgttctgggcgttacgcggcggcggtgggggcaacttcggtgtgaccacctcgctgaccttcgccacgttccccaccaaggacgtcgatgccgtcaacctcaacttcccgccgcagtcgttcgcgcaggtgctggtgggctggcagaactggttgcgcaccgcggacccgaacagctgggcgttggcggacgccaccgtcgacgcgatgggcgtgcactgccgcatcctggcgacctgcccggccgggtccggcaacagcgccgcggcggccatcacgcaggcggtgggaatacaaccctccggggtggagacccacaccttcaactacatggacctggtgaactacctggccgtgggaaacctcaacccgcagcccctcggatacgtcggcgggtccgacgtgttccccaccgtcaatgcggcggtggcgcagggcatcgccgcggcggtcaacgcgtttccccgcaacgcgggccggatgctggccatcatgcacgcgctggacggcgcgctggccaccgtggcgcccgccgcgacggcgtttccgtggcgacggcagtcggcgctggtgcagtggtacgtcgaaacctccggtgaccccgcggccgcaaccaactggctcgcctcggcacaccaagcggtgcaacagtattcggtcggcggctatgtgaactatctggaggccaaccagtcaccggcgcgctacttcggccccaacctgtcccggctgagcgcggtgcgccagaagtacgatcccggccgggtcatgttctccgggctcaattactaggcgccggcgccgccgtcgccaatcgatgattagcccgccttggtacggggtacttcctctgcatctgtgtggacgaagggttggcgaatggcagtggagcacggtcgtgcacggtgcccgcgatgcatggcatgggcgcagtaccggtttctggaacgcgacgacagcaagctcgaatatcaggttagttgcgatgaatgcggcaaccattactccgaggtgaccgccacgacgccggccgcgtagcccggtccgcgccgccgtcgcacctgccgcattacggaagttgctactcgtgtaaagtcgaggactgcgagccaagacgcccccttcggagcagcgcctagtgcgcgcaaacgccgtgcggaacgcgttgaaaggggcggcgtggacgacattttggcccaggccaccatcttccagggaatcgacccggaggcggtcgccgcgttgtcgcggcacctgcaacacgtgtccttcccgcgccggcgcaccgtcttcgtcgaaggcgagccgggcgacgacctctacgtcatcgtgtcgggcgcggtgaagattcgccatcagacggcggacggccgcgaaaccgtcttcgcggtgttaggccccggcgacgtgttcggtgagctcgcgctcttcgacccgggccctcgaacctcgacggtgatcaccctgaccgaggtggaagccctccggatggaccgcaatgccctgcggacgtggatcatcgaacggcccgaaatcgccgagcaactgctgcgggtgctcgcgcgccggctccggcacacgaacaacaccttgtgcgacttgatcttcaccgacgttcctgcccgggttgcgaagcaaatcctggacctggcaatgcgattcggcaccgacagcggcggcccggtgcgcgtcgagcatcatctcacccaaaaagagctcgcccaactggtcggctcctcgcgggaaacggtcaacaaggcgctggcggacttcgcccagcgggggtggatccgccagcagggcaaggccctgatcatcgaccagcccgcgaaactggctcggcgcgctagagcctaagctgtcggcgccggtaacggcaccggtctcggcatgagcacgatcgtccacccgtccgggtccaagaaggcgtccgctccgttgcgccgccaccacgggttgtcgagcacgacttcctcggctccggcctctcggcagcgggcggccacggattgctgttgggccgccgactcgaagtagaacaccagcaggttttcccgggtgggcgccgtgccgtcgatcccgtcgcggtgggccacgaattcaaggtggtattgatcgccgggcaggccgaacatgaccaccgaccattcgtcgtcgcccgcagagtgcagctggggcaaatgcagtacgtcccggtagaattcgacgatccggtcgagctgggcggtgggtcgggcgaaccgcacttgcaccgcgggaagctgcgccggccaggcgccggtgctcggctcaaccatgtggactcccttcccgcccctcaggtgatcgaccagaattccagcagcgtgcgcagggtcgcgaccaacggcagtggttggtccagcatagggtggtgccccgcttgggccaactccacgaagggtcctcgcaactggagcagggagcggatccgttctgccatggcaggcggcaccaggcccgcctcacagcgcaaatagcctacgcggcaacgcattgcggtcagcatgctctccagcgactcttcgtcggcgggcgtcggctgcaggaactcaccgccgaaaatggccggatcgaacttccacacccatcccgcgctggtcttgcgtatcgactcggccgcgatgtgctcccgaacatagggcaggatgagctcttgcgagggaacggccgtgaagcgggccaggatctcgttccgagtccggtattcggtgtgcttgcggcggcgcagccggccctcctcgggcgcgcgctcccacagcggtgagtcgatcaccagcatgctgttgatcttcgagctgtaatgcattgcggccgtggacaccacccagccgcccatgctgtggccgacgatggtcggtcgccccgcgggtccggcggcggccgctgccgccatcacttcgccggcccagatgcgcaggtcgtagctgtcgcgtgggtcgctgtcgccgtgcccggacagatccggcgcaatcacccggtgggtgtgcgaaaagaagggcgcgatgtggtcccaccacccggagtgcgctccgccgccgtgcacgagcaccaccggaggttgatccgcggctccccacacccgcatccggatgcggcaaccgccgacttcgacgtcacagcgttcgggcttttgatcgagcgcggcggtgaaccacgatggcgtagccggcatctggcgcgaacgggaaaacagttcttgaccctccctgttcgccatgcaggccagcacgcccgacgtaccactttagctgcagcggaacgttttcggaagaacgccccatcctgcgggcgcccagggtttttgggggagcgaagggcggattcaggttgcggtggccagcaagtcgcgcaccgcggtgtcgacggtgctcagcagcgccgcatcgatgccggtgcgcccgcggaccaggatggacgcgttgttggccggcggcagcccctcggccgggccgaggccgtccgggaacttcccgatcatgggcagcagcgccacccccagcccggagcgcaccgctgcgtagaggccggacagatccccgcactcggcggcgatctcgtagtcgatgcggtggctgtccaagatcgcgaaggcgggctcacgcagtgtgcacggctcggagaagatcaccagcggcagcgggcctttcggcgcgatggtcagcgtgcgcgccgaaacccattgcaggcgaaccaatcccgacgcgttggcccggtccagaccggcaccgtcgagcatgatcgccacgtcgaccaatccgcggtcgatggagtcggccagcgacacgttgcggtcgaggcggaaacgcacccggaggtcgggaaggcgatcacgcagcgcgcccgacaggccggccagcatgacgtcggcgccgtgctcggtggcgccgatggtcaggaccttgttctcggtggccccgaggtcgtcgagcgcggtgtcatgcgcggccaggatggtccgggcatgccgcagcgccttctgcccgacttcggtgaaaaccacgccgcggccggaacgttgaacgatcggttcgccgacgacggcctcgattcggcgcagatgctggctgaccgcggattggctcaggtgcagggcggcggcagcccggtggaagccgccgcagtcggcgacggcgacgaggctgcgcaacggcgcgatgtccagcacctggcccacggccagcagcttaatccgattcgatcgctcgatcaatccgctgtcttgtgcgtcgaatcacagctattgggcgcagtgctgataagtaagcacgatcggtggcgatcccaaataatcgttggacggctccgctcgatcacgcgagcatgggggcatgactcggccgcgcatgcccctgaccaccgcctcggcggtgacgttcttttacgcgctcggttacccgatcggaacgctggcggtggtcgccatgacgccgatggccgccctggtgctgcggttcggtttggccgcaatggttttggccgtgtggaccgtgatcgccaaggcgggctggccgcgtggcgcccggctcggccacgtcatcgtcgccgggctgctgacccagggcgtgcagttctgctgcctctacgaggccgtgcagctgggcgcgccggcggtgctctgcgcggtgatgatcgcgatgaatcccgtggccaccgcgatcctggcggcgacgttccttcgcgaaccgctcggtgtgcagcggacggtggcgctggtgctgggcgtgctcgcggtgctcgccgcctgctcacagcggttgatgagcacgcatggggtcgacccggtcatcgtgctgcttttcgttgcgctgctcggcctttcggccggaggtgtttaccagcagcgattctgcggcggtgtcgatttccgtgcgatgagcgccctgcaaaacggggtcgccctgctaccagcggccgggctcgcgatgctgacccctttcggggtgcacgacggccgcaaggcgctggttgcggtggccgccatggtgctgctgaacgccacgctggcggtgagcctgtatgtgcgcgccatcaacgcccacggcgcggcggcagtggcgatgctgttcgccgtcatccccgcggtggcggccgcgctgtcatggatcatcctcggtcaacggcccgaccagggggtggcggcgggattggtgctgggcgggctcgcctgctggatcaacaccagggcggcgagtcggccgcgcacgcaacgcgatggcgtcccggctgctgcgccggccgagttgcagtcggtatcgcggtgagcgctggaagtgtcctggccggtggggaccgccaataggcttgcgcaccatccggttgcgcgccgtcgtcgatctgtgagaatgcggtggtgcattcggacggcggccgggcgggatcgcggccaatcacggcgctgtgggcggtccttgcttcgggcgccgtgctgtgttgcccggcgccggcccacgcggacacccaattgtgcgacccgtcgagcgtcgattccactcagatgtgccactacgagaccccgtcaccggatgtccggatggtgtttcccgccaactatcccgacgagcagacgatgatcggctatttgaccaaggtcgacaacgactttcgcaatgcccgctcagcgggtcagacgtcgacgtcgccgacggcgctgaaggttaccggcacccggtacagctccggctcgcaggcggcgggcacccagtcggtggtgaccgagatctatcagaacctgggcgcggcgcacccgatggtttggtacaagtcgttcaactacaacctggccagccagcagcccgtcacgttcgacgcgttgttccggccgggaacacaaccgctgcaggagatcttgccgatcgtgcagaagacgctggccgaccggtaccgggccaccgtctcgattccgcccgccaccgggctcgacccggcgaactaccagagtttcgccatcaccgacgacgccatcgtgttcttcttcgaccagaacgcgctgcagccggccatggaagccactcgggtctccgtcttgcgcagcgcgatcgcgccgttgatcagccccggcatcgcatagtggcgccgacggacgggcgcgttgcgcgatcggcccgagcctcagcgtccccttaatatcctcactggcttcttattttgaggtatgctgcggtgccatgattcgtcggacggcgatcccgtatctggcaagcgacccgacggcgaatgcagatgcagcaccgacgtgagcaacttggggcaggcttatgacgagcgggcataaccggtccgatgaggatgcgatccgcgcgctgatcgatcgacaggaaaaggcatgggccgcgggcgatcccgagggctatgccagcgtcttcacgatggacgcggactacgtgactttcctgggcagccaccacaagggacgcaaagccattgcggcatcgtacgttccgctgttcagaaagctactcagaaatacccgtctagaggtggatgtcacccgggtcaggtttctcactcccgacgtagcgctgatccatgcccatgccgcggtggtgaagacgccgcgacagcgcaatcgacgcaatgcacgggtgaataccagtgttgccgtgcggaccgacaatggatggctgctggcggcttcgcagaacaccactcgccggcgcgtcgccgaaatgctcttggccaagttgttttcctgagatccggcaccgatggattaccgttgctaaggcaatgacactacgaatggcgacgtcggacgacgcagcgggcgtcgccgcggtctacctgccttatgtgcgcgacacggccatttccttcgagacgcagcagccgagtgtggaagaaatgcggtcgaggctgaccaccaccctcgcgacattgccctggcttgtcatcacggacggcccacgggtcaagggatatgcctacgccagcccgcaccgggcacgcgaggcgtatcgctggtccgtggacgtatcgctgtacctggacgcatcgatacaccgccaaggacaaggacgccggctgtataccgcgttgctgaatctgcttggcgcacagggctacatcaacgcctatgcggccatcaccctccccaacgccgccagcgtcggcttgcatgaggcgttggccttcagacgcgttggcgtcttccctcgggtcggattcaaacagcaacggtggtgggacgtcggttggtggcatcggcgattggccgacccgccggcagtaccggaggagccgcggccgtggacgcgactacccgcgccgacgatcaattccgcgctggcggttcaccccgcacaatgaccgggccgggcgtcacggcagctccaccttgctggccagccaccggccgtccaccttctccatggtcattttgacccggctgcgatcgagttgaggcgccggcgcggcgccgttgctcaccgactgatcgacgaacagcacaacctccaccttgtcctcggtggcggagcgcaccgcggcgtcgaccacattcccgtgcgccgccgcattgttgtcgatcagcgtctggcgcagctgggcaccggatttggtgtacatgtctttgaactcaccggtggagccgtcgagaacctcggcgaagttcttgtcgatcgcgttggtgtccacgcttgtcagcgcgaggatgtatttcttcgccgcatcgagggcttgcgccgcggcgacgtccttctgatgctgctcgaacagcagccagccctcgtatccggcggtggcgagcaccgccgccaggatgccggcggcgatcgcacgaacgagcttgaggcgccgtctttttcgcggccgcggcggtccaccctcgccctcggcggctttgtcggtctgttcgctctggtcaggcgaggcctcggccacgtcgggttcgtcggccgccgtcggtgcgacctcgacgtcggcgatgccttccgccgcgacgcggaagcggcgcaccaaccaggttcgccggttgccgacggtctgcagtggtttgcggtcgttcatcagttgcatgcgccggagtcacgaagcgcgttcgcccagccggtggccgagacgatgttcgcgtgggtgacgcccgacggatcctttctcttgatgctgtcgctgatccgcgacagctgaaaagccaagtgggtcatggattcaccgccgtataccggcgaatacggcccgaagttgtcgggttggttggtgatgatcaacggtttgacccgcggggtcagaaaggccgtcgaccggtcgatgttgccgacgacggcgtccgcattccgctgcaccgcagcggccgcatagtcgtcgtgctggtcaccgagataggtattgaagtcgttgatctggcccatcagcgggtcgaattggctcttgaaccactggcaggagtccgacatgccggagatcatctcgggcgtcacccgagaggtgaaggtgttgtagggccagatgtcgaagttcggcgaccaatcgctcggcgccggcgtgaacgccggcagcggcgggggaggctgccccggatcggcgtgggcgtgacccgacagcacgacagcggcggcgagcgcggcgcccgccaggccgctgcctgcccgtcgcaacctcgtcagaaacatcccgccttcccccaggaacacgatatcgtccggccaccgaatatcgaagcatctacatatgcgacaaatcatcattaacatcggccgcgtggaaggcgatcttcccccgaagcgatcgccacgtcaaggcaccgccaccaggtctgtaacggagatgaccgtgggtcatgaccaattcggcacacgcgtccccgcagcgcagccgctgagaccgacaacgaagatcttccgccgaagctgagtagccgttaacatatccgcccgtgggggcacagcgaacgctcagtgacgaacaccggcagccgcgagtggctgccccggggcgcatccggcgatgaccgcccaggacgagcgcgcgctcgacgaggaccgagcacccgacagcgtggccaccatccaggagtggtcggccggatatgtcgtgcggcacccgcttgcctcactcaatacccttggcgagcaatacattctcgcggtacgcacagtcgagtactgcgtggtcgatctgttcaccgggcgcttccaatgggcggaattcgtgcgccagggcgcattcatggcggccacggcggtattgcccaccgtgctggtggcgctgccgatcggcgtgacgctgtccatccagttcgccctgctggccaaccaggtcggtgcgacgtcgctcgccggcgcagccagtgggctcgccgtgatccgccaggccgcctcgctggtggccgcggtgctgacggcgtcggccgtcggctccgcgatcaccgccgacctcggctcgcgaaccatgcgcgaagagaccgacgcgatggaggtgatgggcgtctcggtgatccgccgactggtggtgccgcgcttcgccgcggcgatcatggtcggtgtcgccctgaccggaatcacctgcttcgtcggctttttggccagctatctgttcaacgtgtatttccagcgcggcgcgccgggcagtttcgtggcgaccttctcgtccttcgccaccaccgaggacatgatcgtcgcgctgctcaaggccgtgatctacggcgcgatcgtcgcggtaatcgcctgccagaaaggccttttcaccaagggcggaccggcgggcgtggccaactcggtgaacgcggccgtggtggagtcgatcctggtgctgatgatcgtcaacgtcggcatcagcgagttgtacaacacgctgttccccaggaccgggttgtgacatgacggcctcgacctacatccccggactggcgcgaccgttcgtcggtgcctatcgggtcgccgccgcgcctaccatgcggctgggacacatgctggtcttcttcgtccgggcggtgctcgcggtgcccaccgtgctgcggcaataccggaccgaattcctgcggttgctgtccaacatcgcgtggggcaacggctcgatcgtggtcggcggcggtaccgcgggcgtcgcggtggtgctcggcttcaccgccggcgcgctggtggccgtcgaggggtacaacttcctgaacctgctcgggttgggccccgcgaccggcatcatctcgtcattggtcaacacccgcgaactggcgccgatcatggcctcgctggccttcgcgatgcaggccggctgccggttcaccgcgcaactcggcgccatgcgcatcgccgaagagatcgacgcgttggaatcattggccataattggtaactggcggtattggaaccgtccgaatagcggattcggagagatatcccagtactgacattgcctgcgtcggcggactccgcccttcgtgtacaacctgctaacggtggggcgtgcggttatggccatcgatgttcttgttgcacaacggattcagagcaccgttcggcggccgggttacctgaaggcgtggatccgcgacagctgagcgtggagcgtgtgtagcggcacccgcggtccgaggatcggtccgggacggcgttccttgtgacctcggcgctcgagtcacggcgccaccccgaactcgtcgccgccgaccacggcctggtggccggccgcagacggttcttgtcgtgggcgctcaccgatgccctcgacaccggtgagctgtcctcgaaaccgaccctgccacgattgtggagatgctgttggcagcgctgctggggatggcattgtcggccagccatatcgatttcgacctgggttcccgcgacttcgcggacacgttcggacagctgctgtccgctcagtcgtggcgatccgagacggtgagctccggcacgattgttgaccttccctgtgtgtgacgaccgcggcgggatatttatcatttgtcttgccgataaccgatgtcggggctgaccgtcgtctgcatcatcactgtgcccacgatcggcccggctgtccggcggcgccgccaacttgccgattcgatctcggcgcagtggagattcgtctggtcgtcggcggcagcgcgggcagcggagttcgccgtcggcgagtaggtgctcggcgagttcggcggtgcgggcaacgatcaccgtgcagccagtccatgacccatcagccttgcctatcgccctcgggcgggtacaggggtcagttcgtgttggacgacaccagatttggatcagccgccgtcactgacggtgcccggccagctggtcgcctggggatacgggccggcggcgcaccgtgcgcgaccgcgacagcaccacggtgacggtgcgaccccgccgcacccgatgcgatcgtgctcatcaacgcatatcgtgatacccgcagccctgcaaccacgtcacgccgacaccaccgcggcgatcggaacagcattgctgcacaagccaaatggaattcgacacccggcgcatcgcggtcgccgtcgatcggcccgtgtccacagtgcggcgctggctgcgccgcctaccagcggcacacctggaacgcatctaccaaggcggcacccgacagccactggaactggatcctgacgttcgctgcgcaacaccgcaacctgctgcatcacgcgttgtcgatcctgtcgacagccgcctactgtgaacgccaccgctagggcatcgacgacccgccctggaccctgatcgggcctacacccgaggtcgcctgttgtcgccaccggcctgagcctcatcgcggcccccgcgagccatcgggagcgccgttcggcacgcccgccgacgcccgtcaccacgacgaccatcacgtcgccgcgccgaccaacccgtcactttcagaccaactcccgatatcacgtccgcgccgacagtgacggcatcatctgcatactcagcgacggccaacagagcgcaacgcccgacggtaacagcatcacttcgtttggtggagtacgggtccgcgtgtccgcggtcaacaacgtggtcaccgggcttcccggttcgccgcggcgatgttgtcgaggaggtaatagtcgcgttcggtgctgccaggcgccatcgggtgcggcggggccgccataccgggctgcagtggcgccagcagctggtccttgccgtagatcaggtcggcgcggttgtcgtcggccatttcgtagtcgttgatcatcgtcagggcccgcgtcgggcaagcctcgatgcagaacccgcagccgatgcatcgcaggtaattgatctgatacacccgcccgtagcgctcgcccggcgaaaaacgttcggcctcggtgttatcggcgctctccacgaaaatcgcgtcggccgggcaggcccacgcgcacagctcacacccgatgcacttctccaacccgtcgggccatcggttgagctgatggcggccgtggtagcgcggcgccaccgggcccggcttctccggatacccctcggtgactggcttcttgaacatcgccgaaaacgtcacgcggaaacccgcgatgagtttgaggaatgtaaacatttgtgccctcctgggatcgggccgacttcgagtgcgccgggcctgctgcgctgcctgcctccgagcttggccgcgtccacatgaacctgagacccagactaggccgtgtcatcaaacggcgttcctcgaaacagccctgccgcatcacctcgacgagcgggaacatcaatacacacccgaatccgagaggctgggactgtctaaatagcggtggatccgaccttcattgtctggtgtgcgtcatcgaggtggtcaggtttgtgggcgtccattccgtcagcatcgggggcgggaagccgatccgggagtgcgagcttgaagatggtgcgcacggtccctaggtattggcgtgcgagcggaccggtcgtgtacggcaggtcgaagcgcgcgcatatggaccgcacttgtggtgcgatctgcgcgtagcggttgctcgggagatccggaaagaggtgatgctcaatctggtagcagaggtttccgctgaggaatgccaacaccggcccggcgcggaagttcgcagtgccaagcatttgtcgcagataccattcggatttggactcatcgttcagtgcgtcgggcgcgaacttctgtgtgtcctcgccgaggtgtccgcagcagatcaccacgtaagcccacacatttcgcagcaggttggcggccgcgttcgcggtgagcgtgcggcgccatcgccgaagactcagcgcgggaaagatcagatagtccttgccggcctggcacgccactttctgcaccaaggcggtggcggtagttgtgggcatagcgccactgtgaggagacgccgaccatgtcccactcccaggtgctggagtggatttccgggtcgttcatccaatcccattgaccgtggcagatgttgtgaccgagctccatgttctcgatgctcttcgcggtggccagcgcggcggttcccagtgcccagccgggcccgcttcggctggcggcgatcacaagccgtgccgcgaggtcgaggccgcgctgaaacgcgatggcccgctgaatgtatgtccgatcatgttcaccgcgcgaattctcgatgtcgcgacggattgcctcaagtgcgacaccaagcgcctcgaggtccgcctcccgcaggtgagcgtattcggctgcgtctgttatcgccatcgtcgtcttgcccaagtctgcaaatagtttgggggtcatacctattcgcacagaacgacggtgagtttggaaagcttgctgcgtgtcatcgaggtcacgtccgttcgtggtcgccttgttgaggctcggtggtgtccgcgggagcggcgccggggatcgtgaggcgcacggccagtccgctgagcagaatgtcgagtccgcggtcgagttcagccagtgggtcgtaggaagcccagaccggtgcgagttcgcgtaggtgcccaaactggtcgatcggaagccggtgtagacccagccgcaagacgtggtcggtttcctccggccgctcgacgatttcctgcagttcggtaagtacgtgcccgtacaggaacccgaacaacgcccggtagacgtgcagcgcgtcctccccggtgaacccggccccgatgagcagggtcagaacctcttcgagatgccgcaggattcccggtgggcgcatcccaagcggtgtggccagcggccgggtgaccaacaacggcaccacgttggggtgcgcacgtgccagatctcggaattcgtggccgagcttgcgtagtgcagcggcccagtccggcgttgtggtgtccagcgaaagccgttcgaagaccatctcgacgacgccgtcgagcaccgcggccttgttcggcacatgccgatacagtgccatcgggtcgcgcccgacggcctcgccgagccgccgcatcgagagcccgtcgacgccgtcgcggtcaatgatctccagggcgctggccaggaccgccgcacgggtgatcggcctgctctcaccgtcggcctcgttgttgcgggattcgggcgcggaacttgcaaggcctgctggtggttgggtcatggatgctgccgccttccgggcgtgtctccagtgttgatctccaccgtaggcctacactgtagacaccgcaatgccgagtcaccttcacgctgttgacagtagtagatctatgccgtagatatacaccgttgacaagctcgacgatgtggcgtgtactggacttctaagcatcagtagaggcgccgccatgatcgacatcgttggaccggttgccttgctcgccggtggtcgtggggttcaccggggtgctgaccaacacgggctcgctggcctatcggccgcgaatggcgccgcattcggcgatgacatcaccgcgccgacgcgcacccctccgtcctcggggtcttcgttggcgcatttcgacgctcggcttgagcgtgcagccagccggtgtacggcgttccgcgggacagggcgagccgcccgccacgatctggagatgtcgctggctcgcccggcaaccagtctcgcccatgtcttcatcccgcgttcgcgggttatgaacaccgagaacccaaggagtccgcaatgagagtggctgcaaagattgcccacaagttcgaagccgccaagggcagcgcgaagaaggtcttcggtcgcgccaccggcaacaccggcatgcgggccgagggacgcgccggccaggtcaaaggcaacgccaagcaggcaggcgacaagctcaatgacgctttcaaacactgatcccgggcacatccgccccgatcatctccacgagacttaggtaactatcatgatcatcttcggaattgtccttattgttttggggctgctcctcccgagccttgcccccacattcgcgttcgcccatgttgtcctggtcatcggggtcatcctgctggtcgtgggcctgctactcatgctgatggggcgcaccggtcacgccatcggcggccggcgtcactactactgaccgtggttccgtggccgacggcatcgagtcgacggccacgatcggccccgtgacccgacagtcgagcactaccacttcgagactgcacagccgcagatggcaccgaccaaaccgccacgctgcgtgcagaactcatgcctcaccaactcgcaaggagccgatatgtccaccagcagtgccgttttcgtcgtactcgtcgtgttcgccacgaccgtgcccatcgcaatcttcgcatgggtagcgggcaaaaaacaccgcaaagttcgccctgcggcgcccgacaacacccaccaatccgtcaaacagggagacccaccgcgatttcgacagcgcgaggcgtgggctgacgaggccgccgacctcagcactgcgcgcggtcagaagccgacatctgagcgaccccagcatggggcctgcctcaacgggacggcgtccgccacaacgcgtcgccgaacctccctgagcagctcgacgacccaatgggaccgagcggacacgatggatactctccgacatgcgccccatgagcatgtgaatgccgatcacaaggaacgccaagacaattgacattatccacgatgccccggacggtcggcatagaggaagagttccaccttgtcgacctcaccacccggcggctggcaccgcgggcaccagagctgcttggactgctgtctgacggttatgtggccgaattgcagagctgtgtcgtggagaccaacggcagtgtggtcagtacgcttgcggaactgcgggccgatctgactgagcggcgtcgagtcctcgtcgataccgccgctacgctcgggttgggcgtggttgccgctggggcggttccgttgtcggtgcccagcgagatgcacgtgacccagacttcccgttatcagcagatacttgccgactatcagctgttggcacgcgaacaactgatctgtggaacccagatacacgtgggaatcgacgaccgtgatgaatgtcctggtggccggtcgggtagccgcctatgttcccactctgcttgccttgagcgcgagttcgccgttctggtccgacggatctgacaccggctacagcagcgtccgaacattggtatggcagcgatggccgaccaccggattagcgcctccggccacgtcagccgcggagtacgacacgttgatctccaatctcattgcgaccggagtgatcaccgatgcggggatgtcgtatttcgacgttcgccccgccctgcgaactcccaccttggagctgcgcgtgtgcgatagctgtccacgcgccgacaccattgtgctcatcacggcgctattccgcgcgctcgtcgaacgcgagatccagggactacgcaccggagtgcctgccgccatagtggtgcccccgctcggccgtgccgcgctgtggcgagccgcccggtcaggactggaaggtgacctggtggacttgatacatccggcgagtcgccccgccggcgatgtggttaccgacttggtccagatgctccgcccacagctggaggcatccggggattggcaggccgttgagggcctggcgcgcaaggctcttacgcagggcagctctgcggccaggcagcgtcgcgccatgcgcacgcgcaatgacctgttcgacgtcgtggatcacctcatcgccgagaccgccgccgtcgcgcccggcgcccacggtacgttggcaacccgtcgtaatggatctgacgggggctgagagccaccgtcggcacggcgcaaacaaatcgctagaccgcggcctccattcggagctggaccggcgtaggatcaacaccatcggtggtatttcgtacacacagccagttcgagtgtggcatcgctgattcgaagtgatatggccgcatcacgcggtccagatgggagcgtcgccatgacgccacagcagacacgcagaaacgatgagaacaccatcgtgccggcgcgcacgccgcgcctccggttaaaacccaaagcaccccaaagcggctatgtcgatggcgcctggtggccccgcagcgatgacctcagcgcagagttgccagacctgttggcagtgctctcggtgcgcctgggccgcatcgaccgagtgctataccacctgaacgcctgggcggacgcgccacgaaagctcgccaccggaggacgggcggtacgcctagacgggtaccggcttcagccgatcaacaccatcgaagttctcgggctcgagggtgaccgactcacgctattggtgattccgcccgacaccgacgcgaacgacgcccaccgcaccatgatgaccgcggcacaacctcgcaacgccgcgaccgtcgacggattgctcacgatcagccagcgagaccgggacagccgcacccaggcctccaccgcacaagaacgctgggaatcagaaggcggaactacagcttccccacggccggcgcagctccccggctgacgccggaacctcgcccgcggccccgcatccgagggaggacatgccgggcacttatgagcggtgacgaaacagcccgtgccgcttccgcttctcgtcaccggccacctcagtccagccgcccaccggataggtcacgggctgcattgttccagcacggacaacctccaacgacccgtcggcgtgcttgacgtagcggtcaccgaagcgcgcaaactcatcagtgagcccatcgttgcgggttacttgcacagtcatggtcaaatccgatccctggcgatatcgccagcatcccattcttcagaagccttcgccgggatgggaattcgggaaagcactgcgtggtttggagatccctgaagcccagcgctgctgggcaacgccagcccgatccaagctgattcggacgcgcggttggatccccagaagccgatctacacacgtctcgtcgctgggatgtgcggccctcatcatcgtcgcatgcgcatcggaggcatccgcgcacacagccacgaccagcagatcgagtcgacggaatcctgatcctagcaggctgacggttgagataggttggcgctcatatccatccaacttgaccggaccgccaccagcgtcgagttttcgcggcgcagaccgccagtcagacaatcgatagagtacccgttcgatgcggcccaggcgcaccgagagcactgccaacaggtctggcagctctgcgctgaggtcatcgctgcggggccaccaggccccatcaacataaccgctttggggtgccgtgggtttcaaccgaaatctcggagtacggaacgggccctgcttccgttgcggattctcgaccgctcgtagcgtcatatgaacgctcccatctatggccgagccaatcgacctaggaatcgatgctccaaaccccatgggcaatctgcacgaccgaacaccaacatgtttaacgatactcgcagtcacacaaaatagcgataggcgaggacgcatatgacggattgcgcgaaggaaccacgcagggcgccttacaaatagctgttggcgtcaggcgggcttgacccttcgactaccgcgacgccgccaccgtagccacccccctcaacaccgcgtcgcgctggtgccggccgcggtgcacaccgaccgaccagccgacatccactttggcgcacggcagctcacccatcaaaggccacactacgccgacgccgccctgccgactcctcgacaacggcccaccctgagtgtgtcgccgcaagtgcccagggaattcagatcacccatccacacagggagagtccgatgaagacggtgtcggagaacaccttccgttaacacatccagaacagccggcggcggatcaccggttcaggacacgggcgccggactggcgtcgccgctgcccgtcccctcaacgtcgggatcggtcacccgggcatcaacaccgtaggcctcacgaaacttcactccgagaacgaccaggcgcatccacaccgccggcggatcggtctcctggccctcgacccgtttgccgaacgcggcaccggtgagagtgaaccggacgcgatcctcgccatcgtcaaccccagccaccaatgtggccaggccccgcctcaacccgatacgtggccacaaattcgcgctcgccgtcccgaacagccgaactcgatgagccatcaaccgcaccacacccgaccagtccaccgatcaccgcaggcagcgctgtactccgcagttcctcaaccgagatcttcgaccttgacgtcccccgcaaattgatgcaaatcatcgatccgagcacctgctccgcagtaatggtggcctctggtgccgccgcctgcgaaccgcgccgataaatgcatcactcgatgataggcgagcaaacgggaacgtgccggggcgtggtgtaaatagtggcggcgtgtcggtactgatgtagagggccatcgcgtgagtctctgtggtgaaacgaccaaggatcactaccgagaggaacatcgcgatggccctggaccagtctgccttgctggaggtgctggacgcattacgcaatgccgatgccgctgatcggatcaagcaggccgccgagacgatttatcaggcactcatcgatgcggagctgacggcggtgatcggcgccggtccgcatgaacggagcgcatcacgaaccaaccagcgcaacgggtctcggccgcgcacactgtcgacgatcgctggcgatttggagttgcggattcccaagcttcggtcgggctcgttcttcccggcgctgctggagcggcgccgccgggtcgatcagtgcttgttcgcggtggtgatggaggcctatttgcacggcacctccacccgcaaagtcgacgatttggtcaaagccctcggcgcggacgccggcatctccaaaagcgaggtctcccggatttgcgccgatctggacaccgaggtaggcgcctttcgggaccggcctctatccgaacagcacttcccgtatgtgttcctcgacgccacttactgcaaggctcgggtcaaccatcgggtggtctcccaagcggtcgtcatcgccaccggtgtcgcggctgacggacgccgtgaagtgctcggcttcgacgtcggtgactccgaggacggcgcgttttggacggcgtttctgcgctcactgaaaacccgcggcctgtccggggtgcagctggtgatctctgatgcccacaccgggttgcgcagcgccatcgaggccatcctcatcggcgcatcttggcaacgatgccgggtgcacttcctgcgcaacgtgctcgcccaggtgcccaagggatcagccgagatggtcgccgcagcgatccgcaccatcttcgcccaacccgacgccgaacatgtgcgagagcaactcgacaccatcgccggcatgctcggccgccaactgcccaaggtcgaaacgatgctgcgcgaggccgccgacgacatcaccgcattcgccgatttccctgtcctgcactggaaaaagatctggagcaccaaccccctcgaacgactcaacaaggagatcaaacgccgcaccgacgtcgtcggcgtcttccccaaccccgccgcgctgctacggctggccggctccgttctcgtcgaagcccacgacgaatggcaagtcgccgaaaagcgctatctctccgagaccaccctggccctattacatccccgctccgattcagccgaccaatccgttgccgtccccgccgccatcacggcatagtggaaactcgcagagcctcaggcgaaacgccgatcggctttacaccacttcacggggcacaacccgagcaaacagctccgactgcacgttgaacacactgttcagttgttgctgccgtcagccaacaccccaaatctagacgccaagcaaactcctggaccctactcgtcgaacaatcccggcagcccaacgtgaaacagtgcgacatcgcgcgcagtgtcctgttctccaagatgtattgcgaagcagcgattcccagtcatcgccggtactatccccgggcccagccaggcgcaaccagtcaaccaacggtccggcccaccggggccgactcttctggcaccggccccggttgactgacacgttgtgcgacagcgaccgcgacattcaagtgcgacgccacagaaccgcgctgactgcttaacccgaggtcgcttttttctgtgacgcctaacggcgaacttcgattacgaccactcatccgccgctgcaccacgggttcccgccgacaccggccccaaaccaatccgtcgtgtcggtcgtgctcatgccctacacaggcgggtcagggccggacgctgcggacagcgctcagcatcgcaccgcgtcggattcccctggcatgtcgacgaatcgcctagcggatcttctcaggaattgagtccagcgcacgtagcacctggacggcgagcttgccagcactatcgtcgtcgaatatcgccgatagtgctgcactatcgtcgtcgaatatcgccgatgtgatcagtgtttgtttgacgagttcaacgcgcctttcgtagggcgtgcgaaacgtcgtggggccgttcatgattttcccattccgtcaagcgtgttcactcaaccgagatgccgctcaacaccctccacagtaccctgcgcgctcctcggagcggtgcggccagagacgacgatcccgaggctgcacttcgtcgggactgtcggaacagagccatccgcttaggaggaggtggctgataatcggcgcctgccttgcgcaagggttccattcccggggacgaggcccagtccgtggcggccttgacatcgcgtcatcacgagttgcggcgggcgacctcggcggcgtagcgggggcgagtgttgccggcttcttcgctccaggtgacggcgcgtttgatgctgaagccgaggagtttggcgagcacgacagcgggcagttcgccggcgaggtcgatcagcgcggtgttgcgggcgatccggggggagatgccaattcgtttgagccgcagccccacttggttggcggacaggtgcccaccggagcgtcctccgggaaacagccatggattggtgcccacggtgaccgcggcgtatccgcggcgctgctgtacgagatcggcgagcaggcggtcgacggggctgggcacggtgagcgggacggcgccgagggtgagttggaccgcgtcgtcggtgatggtgacgtcggcaaccttgagggtgaccaggcgggcggcgggttggctgtagagcagcacgagcagcccggcgacccgatcgcgcgtctccaagtcggggtgttcgatcaggtattggatcaggcgccatcgttcgtcgtcgccgggcagggtgtggcgggtgcggcgggtttgcggtacgggagccgcgacgtcgtgggcgtagccacggtggaccgcccaggcgaggaattggtggatctggcggcgagtggggttgcgcaccaaccagtcgtcgacgaacgcctgctggcatgaggccaaggccagtccgtgcgcgttgagttcggagacgaagtcggtgatggcggcggccatgatctgggcggcgaggccgtggttgcgtttgagtggtcctttgtcggcgcgggcccggagtttacgcaaatgattccattcggtgaatgcgcggacggccgcgcgatcgtcgcggttgctgatggtggccagccgggcggcgatgtactgctcggtgcggtgcagataggggtcgcggtctggcagaccctcggcggtcaccaggatgttgcgaagccattccacggatttgctggccgggaggtcatcgaggtcgtggtggctgagggtgtcgccgagttcggcgagctgcgcgggcagttcactgttcgatcgcatgcgtctgacccatcgcagcaccggcatggcgtcacattgcagcaacgcctcgacgatgcggctggcggcgccgctcaattcgccgttcttggcgaacaattcgcggagctcaccgggacaggcgcaggccgggcacagcccacggtggtacgtccgtccatgggcgccgcattgcacacagtcggtgaaataggcgggttcacgttgcaggcaggccgagcacagcggcccgaccccggcaagccgcgccgagacccccagcgttttgccgcaccgcgcgcacggttcccgacttcgtgcgcacgggttacacaccggctcaccggcgtcagtccgggtgtgcacggagcggatgttgccgcataccgaacagggttggggtgggcgctgtttggccgagcaggtgccgcagatcggctttcccgtccgggtgcgggtgcatgggcgagtacgtccgcacgagctgcagaccgcggtgggtgccgggtagcagcgccggcagagcttcgcttggccgtcatggtggttgatgaagtccacacgaccgcaccgtgtacacggctcatgattgaccggatcatgctcgaaacaacggtgacagaggcgctcgccggcaccgtgataattgataaggtgacgctggcaaccgcaacgagcgcaggtgccgcggctgaagtggtgaccccagcaggtatggcagcagcgcaacccgtcaatctggctgccgagcttcacggtgcgcaaacacaacgggcactgcggaaggcgcacattgtcggcaccggcagcgacaagtagttcggcgagccgcaccgagaccgccgagcggtgggcgatctcaccgcgaaacactccgggggtgtcctgcaagatccagttaagctcgcgctgcgcgaccgccgtgccgaacaccgacgccacccggtcaatctcggtggccgaaagcccggtccgcagttgcgcgataccgtcacgaaccttggcggcgtgatcgacgtcgggttcgggcttgcacctccgacacaacaggccatcgccgtgccgcggccggtagatcaacttgtccaccgcgccgcagcccgggcattcaccgacagccggctgccaaccctgcatcgaacaggctcggcagatgcgcttcttgagcttgcgcgagtaggtttcggaatcgttgcggccgcactgggcacaccgcggcgctcgaacacgcatggcgccgagttggcgcagacacaggatcagctgctcgatgtcggcggcgcagtcgctgccgccgggcccggtgagcacgctaccgtcgcgccgcagcgttctagacagcctctgcaactgcgcggccgacaggcccatcccctcgatcgcggtgcggacatcgtcgtggctcaggtgcggctcgatcgcgcccactgcagtgacgatcaccgtcacgaactcgctgcggtttccgcgcatccgccggcctaggaatccgcgtcgacgatcttggcccggacggggcggtggccaccaagttcccgcgtcctgaccggtttgctgcgctccggtgcgcccgcggccttcttcgccgaggcagctgtggcgggcacgatctcgatcaactcgtccatcgcacacctcaaaatgtccaccagtgccaccagggtgggcaggctcaaccgttccggtttctcggtcacgagccggtagacctggctggccgacagctgcaccccgcgttcggccagcagtggccgcaacgctgtcgtgttgaacagtccgcgttcggccatcagcctgcgcagatgccagtggtaatcggcggtcattggtgtccctctccaaagctggacacccgccccagcgcgtcggtgagcatcttgttcatgaactcgccggtgacatgggtatagatgccggtggtactggcgaaccggtgaccggaaatttcctgcaggaaccgtggatccacgccgtcctcggtcatgtggctgatgaacgaatgccgaaaacagtgcggggtgagcttgcgatccaagcccacctcatcccggatgtcgtcgaaggtgccggtcaacgtccgcaccttcacctgcgagcgccgttcggtcagccacagcgcctgcttctgcccaggctcatacaacggtcgaatgttgttgacatagtccaacagtgcctccgccgcccacggcatcaacgtcggcaccgtccgccgcttgggcggcgaccctcgcgaggccttcccgtaccggacatgcagaaacccacactgccccaactcgggagcgtgcggattgcgatacatgtcggccagatcgagccgacacagctcgctgatccgcaaaccccagccgtacatcaccttgaacatcgtcgtgtcccgataggcggccaacgtgcccttacgccgcgaccggcgagccttctcgacctgcgcgtcggcgcaatcaaggaaatcctgaagctccttgcgggtgaacggccgacggcccggatcaccctcatagtcgacaagatgcgccgaagtgttccactcgtgacagatctgcgtcggatgatcgccgaaccacagttcacactgcgccggccagtcgtagaagggcgaggtgatgaagctacagaacagccggaccgcgccctgcttctgacggatcgtggacttcgcccgagacagcgaccccaccagatgcgcgctccactcatccatcatccgagcggtccactcccacggatacgccccagaaaactcgatgaactcaccgacgcacgaggcccgcaccttcaccgtgttctccgcacacaaccgcccacccaactgctgcttggcccaccccgacaacatcgcccgcaccatgtcgtcctcgggatgaagatgccgcacacccggcgccaactccagatgcgccgagccaggcgccggcgactcccgtttcctgcccaccaccccccaccttccaatgcactaaacatgcatcacatgcaatctacgtcagaaacgcccagttcggaagcccccgcccgcattacatgacgtacactccgtgtgtcgaacaccgacatcccatcccgatcacatcatgcatctgatgcaattccgcgtggttccgccccatccccttcctggtcacgacgcggctgatggcatcggtgatcgccgtcattccgctctacatcgcctgcctggcggttacctacctgacctgccaggtggtggccaacatcatcagcggcggatccatcggcccgtacctgcactacttcacgatgatgctgagcgccaaggacatcgcctactcggtactcaaatgcgtggtattcgtctggctctcctccaccgtgcagtgctactacgggttctacgccgccggcggccccgagggtgtgggagtagccgccgggcatgcgatgcgggccagcatcaccgtcgtgatcatggtcaacatgttgctcaccatggcgttgtggagcatcgacgcgggcgcgagattcggtggctgaatggcgaattcgttagacttcgacggccgcggccccaccgaccaccagctgctggccctgggggcgacggtgctgctgatcgccgggctgatcaccggcggcctgctgctgaagtccaccgggcggctcaacgactacgtccgcgtggtcgccgagctgaccaatgtgggtgacgggctgccggcccggtccgacgtcaagtatcacgggctgctcgtcggcgcggtcgacaacgtcattcccgcggcctacggcaagcccaactacgtgcacatcaacctcaaacccgaatacgcccaggacattccgagcgcggtgacggcgcgcgtggtgcccagcaacgtgttcgcggtgtcgtcggtgcaactcgtcgacggcgcgccgggccccagcatccgcaacggtgcgcgcatccccgaagacctgcagctgtcgacggtgatcttccagaccaccatcagcaagctgcgtgacatcctggccgccaccgggcggggccgcgaagaccacaccgtcggcatcctggctgccgtcgccgcggccaccaacaaccggcgcggcccgctgctcaccgccggtgcacagttgacccgggtgctcgacgagctcaacgccatcgtcgccaccgaccccgggccgtccacggtctcggcgctgctggacgccacccgcgggttgcagtccaccgcgccggacctggtcgacgtcctgcacgacgcggtcagaccgatgcagaccctggtcgagaagcgcgagcagttccggtcgctggtcaccggctcctaccacaccttcagcgtcaaccggcaggccttcgacaaccacaccgaccagctgatcgagatgacgcagaacctcaccccggtcctcggcttcttcgcgatgaacagcgacaaattcgtgcccatcttcaccaggctgaatcgactgtccgacaagttctttcaagaggtatgggatcccgagctcgacaccgggaacatgcgcgtcaatctggcgttgacacccacctacacctacacccgggccgactgcccgcgatatggccagctgcaggggcccagttgtttcaccgcgccgacgatcgcggtgcggccggacctgcccgaggtgctgctaccgcagaactaccacccacccacggatctggcgccgccgccgggcacccagatcggacccgacggcaacctggtggcgaccggccctccgctgtacaacccgaatcccagcctggccgaccccaacccgcccttgccgtggtggccatggcagatcggtcccgcgccccgggtgccgggcaccgccgaccccgacgacgcgccgccgcctccgccgccgagcccggccccgccgggtccgccgccgagcccggccccgccgggtgcggtcgcaccagcggcgtacggcggcaacgtcggtcccgttggtagccaacgcgaacgcgaccagctgggtctgatcaccggccagggccgcccggcgtccgtggcgacgcagctgctcctggggccggtggcgcgcggcagcgcggtctccctgcagccacgggcggcgacgggcggaccgacatgagggtgcgcggaccgctgatcggcctgtcgctgttcatggcgatcgccatcgccgtgacctggatggtgtatgccaccctgcggcgcgatgtggccggcccgaccacgccgtacgcggcgatgttcaccgacgtgtacgggctacgggtgggcgacgacgtccggatggccggcgtgcgggtcggccgggtcgaaaaggtggaattggccgggaaattggcgaaggtgtcgttcatcgtcgaaaacgaccagcggttgtacggcaacaccgtagcctcggtgacctaccagaacatcatcggccagcggtatctggggctgtcgctcggtgaaaccggaagcaggacaacgctgtccgcaggcagtgtgataccggtgcagcagaccgatccctccttcgacgtcggcaagctcctcaacggcttcgagcccctgttcaccttgctcaaccccaaagacgcggacgacctgaccaagggtgtcctgcaatccttacaaggcgaccaagcctccattccgttgctggtggaacagacgtcgacgatcaccaagaccttgtcggcgcgcgaccagtcgctgggcgatctgatcagcagcctgaccagagtcaccgacaccgtcgcccggcagaacgacgacctcgaccaggccctgaaccaaacacgggacgcggtggccaatttcgacgaccgccgcgcggcactgcaggacgacgtgggctcgatcgcccgggtgacccggcggctgtcggcgatcgccgacgacgtcgacccgtcgctgaacgaactgataacccgggagccgggattcagcaagcacctggtcgggatcgagccccagctggcgttcaccggagacaacctgccgttgctgctcaagggatttgcccgcgccgtcagtgagggctcctacggcaacgcctacgcgtgcgacctgaacgccaccggattcttccccggactcaacgacatcaccaccttcatcgtcaacgcggccacgcccggcaacgcgtatccgatcaccacgaaaaacctggggtggcacaccccgcgatgcaggaacatggccaatggctgacacacgcaaactgcggtggctgcgacggcgcccgctggagtcctacaaccggacatggctcgggctggccgggctggtggtggtcgccgtcctggtcgcggtgtcgctgggaatcaagctgctcggcgtcggatacacccactacaccgccgaattcctgcaagccgcaacgctgcggcccggcaaccccatcaccgtcgccggcatcgaggtcgggcacgtcaccagcatgaaactcgccggcgatcacgtcgaggccggtctgagcgtgcgcgacaacgtgccgctgggcaaggacacccgagcggtgatcaaggtcatgaccatcctcgggtcgcgttatctggagttggtgcccgacggcccgggttccctaccggccaacacgatcccgctcgcccacaccgaggtgccctacgacctgcagtcgctgctggaggacgccaccaccaccttcgagcaggtcgactccgaccagttcgcgcagtcactggccgtgctgggcaagcaactcggcggggtgccgccgctggtacctcaggccgtcgccaacctgcagacgttgtcgacgatcaccgcggaccggcgcggccagctgggtgcgctgctgaaaagcactcagcgcgtggtcaatacgcttcgcaatcagcagagcaacatcgggcatctgatggatcagggtcaggatctgctcggccacctggtggcgcgacaggccaccttccacgccatgttcgcggcgctgaccgaactcgtggaccaactcgacaagatcgtcgtcaacaaccggccgatgctcgacgaattgttcgcgaacctgcaccagctgaccaacatggtcggccagcacgacgacctggtgcgcaacatcctgcaggtcgccccggtgacgctgcggggcctgaccaacgccaccggctacggcccggtcgtcgagttcaacctgcccaacgggctggccatcgactcgtggatgtgcgcaatcagcggccgggccaaggaattcaacatgatccagtacttcaaggactgcaaatgacgtcccggcgacgcaaactcatcgccctggctgccgccgccgcggcgctggccgccgtcgccatcggggtggttggccactacgtcaaggcccgcctcgacaccatgacagtgacggcccaattcgacagcgccgcaggcctgtacgagggcaatgtcgtggcggtgctcggcatgccggtgggcaaggtcagcaaggtcacgtccaagggcagttatgtggaggccgagctgacggtggacaagaaggtgaagatccccgcggcggtccgcgccgtcaccatcagcacctcgatcctcaccgaccgccaggtggaactgacgccgccgtatcgcggcgggccggtgctgaagaaccacgacaccatcgggctcacccggaccaagacgccggtcgccttcgaccgggtgctcgacatgctcgacaaggtgtccaaatcgctcaagggcgacggcaaaggcggcgggccgatcgccgacgtgagcgacgcggcggtggccatcaccgacgggaacggcaagaagatcctggccgccctcgatgagctttccaaggcgctgcgcctcagctccgagcggggcgtcaccacccgcgagcagttgaccaccatcatcaccgacctcagctcgatcaccgaggccgccgcgcgcaacgacgccaaggtgcgcgaattcggctccaccacccgccagctcagccagatcctggccgacgagaagttcggcaccggcgccaccggccgcaccatcaaccgcatcctggaagaggtcaccacgctgatggagaacaaccgggacaacctcaaacaggccgtccgcaacggcgacaccgccgccaagacactcgtcgacgatcagcgcggcgtggccgagctgctcgacgtgctgccgctgaccctggaaaacctctacaacaccgtcgaccagaacaacggcgcgatccgggtgcacggcctgctcgacaaggcgctcaccgacagccagtccgccaaggagctgtgcaacctgatgcatctgcgccaattaggttgcagcacgggcacgttgcaggactacggccccgacttcgggctgacctacatactcgacggtctttcggcgatggggcagtagcgatgaaggcaggcaagcgcaaggcattggcggtggcgtgcagcgcggtcatggccagctcgggttgcgccaccaacgggctggccagcctgccgctgccggcaccggggatcggctcgggcggatacctgctcaacgccgtcttctccaacgcgctgaacctgcccgcccacgcgaaggtcaaacttgccggcgccgatgtggggcagctcgaatcgatggtcgcgcgcaactacaccgcggtgaccacgctgcgcatcatggacggtgtccgggtccccgtcggcagcaccgcggaactgcgttcggccaccccgctcggggacgtgttcgtcgcgatcaagccacccgtcccggccgatcccagcgccccgctgctcaaggccggcgacaccatcgggctgccggccacccgcgccgccgccaccgtggaaagcgtgctcagctcggcggccctgctcgtcaacggcggggcggtccgcaacttcaccaacatcgtcaacggagccggcaaggcaaccggcgaccagggccgcgccttcggcgacctgatcaaccggaccaattcgctgctgaccaagctcaatgcccgctccgaccaaatcgacgccgcagtcaccgaaacggcggcgctggccgaccggttggacgccaagaaccaggcgatcaccgacgtgctgcgggccgtcggccccgccaccgacgtgctgtccggcaacgccgacgagatcgctgacgtggtcgacgaactcggggccaccacccgccagctctccaaattcccgtcgattgccggcacggacaagaccggccgcagcgtcatcaaggacgccaacgccatcgccgccgcctggaacgacgtcgtgttgagccccgacaccagcctggccggcctgaaccggctgatcccgccgttcgtgaaagccacgcccagccaagccatctcggtccgcggcagcttcgaccggctggtactcggatcccgccccggcaccggcgccgagaccgggggcttcaagggtgatccggccttccacgggccgatgcgccgcgactggaactacctgatcggctcgatcaagtacgtgttgtggcggctgcaggaacgggtggtgggccgcgggccgcaaaccccgatgggccagagcccgtggacgccgtccggtccgccgctgccgccggcccccgccgggcaggcgcccccggatcccatggtcccggagccaccgcggtgatcgacaccctcggccgtctcgtcgtcggcgtggtgaaagccggccaccgccaacggacctggctgtccgggctcgccctgctggtcgcgctcgtggtcggcgcggcctacctggcgctcggcgccctgcgggtcaacccgctggagtcgacctaccaggtcaccatccggctgcccgaatccggcggactgctggccaaccaggacgtgtccgtccgcggcatccgggtcgggcggatcagatcgctgcgaccgatcccgagcggtgtcgaggtcgtcgccaacatcaacgcgcacaccaggattcccgcatccagcccggtgcgggtgtccgggttgtcccccgcgggcgagcagtacatcgacttcgagcccacctccaacaccggcccgttcctatcggacggcagcgtgatcggcccgcaacacaccaccacgcccatcccgctgtcgcaggtgctggccgacgccgacgggctgcttgcccagaccgacccgaagaaactcgaaatcgtcaagcgggagctgagtttgagcaaccagggcccgcaaaaactcaccgacatcatcgacggatccaccttcctgctctccaccatggacccggtgctgccgcagacggtcagcatgctcaagaccagccgcgtcgcgctgaccaccctctccgacaagaacgccggcctctcggtcgccgcccgcaacgtcggcgacctgatggccggtgtgaacaagatggaccgcggctaccgccgcctcgtcgaccagaccccgcatgcgttgtccacggtggacaacctgttcgacgacaattccgacaccatggtcgggctgctggccaacctggtcaccaccgcgcgggtcgtctacctgcgggtcccggcgctcaacgcggtcttccccaactaccgcgggtccacgctcgaggcgttgatgaccaccatgcacgaacatggcctgtgggccaccgccgatatctaccctcgctacacctgcgactacggcaccccccggcgcccgtcgtcatcggcggactaccccgaaccgttcctgtacacctactgccgagacgacgacccacaggtgctggtccgcggggccaagaatgcgccccgcccgggcggcgacgacaccgcggggccgccccccggggcggatctcggtcaaaccaccgacccaacacccaagggccgcttcaccattccgacgccctacggcgggccggtgctgcccatcgagccgccgcactgaacccacctcaagaccgcaaggagacaacagcgtgaccgtcaccgccgaccaggaacgcgccaccgccgacgatgtcgagcagccgcccgacgatgaccgaaaaaccacggcggaccgtaccgaatctcagccgaaaaccgcggcgcggcaatggaaacggtacggtcgcgccgcgctcgtcgtcgccgtctacgcgggcgcattcggcctggccgcggggctgggctggaaactgtgggaccagcgtgcggtggcccaggccgggcaggcggcgcagcgcaccgcggtcgactatgcccaggtgctgacgagcatcgacgccaaccaggtggaccagaacttcgcggccgtgctcggcggagccaccggcgagttcaaagacacctacacaaaagccagtgcgcagcttcggcaattgctcatcgacaacaaggccacggcgcacggcacggtggtggactcggcgatccaatcgcagagcaggaacagggtggtggtgttgctgatggtggaccagacggtcagcaatacggtgcgacccgacggccgcgtcgaccgcagccggatgaagatcaccatggaaaatgtcggcggccgctggctggccagcaaagtcgaactgccgtaaggcgtttcgggcgatgcgcatcttccagttctcggccggcgcggcggcggtgacgatggcggcgctcaccgcacccgtggcgtcggcgtcggcgcagtcgttctgcggcgatctcggcggcgattgggacgggcagtactgccacacctcggtgctgtcggaacgaaaagccgtccgcgacatcaagatggcgatgcccggcgatttgatcgacaacccgaccagcggcccgccgattcgccaatatctgcgcaccctgatgaccaactggcgcagcaagggcgcctcgatggtccaggacagctggggcgaggagaactttcaggtcttcggacacggcccggcccaaagcgtggtgttccacgaggactaccacgccgacggtccggccttcaacaacgcctaccgcaccttcaccttcgacatggccaacggcaggcagctacagctggccgacatcaccaaacccggtgtggacccgttggccgccatcccgccgttggccgaaccgttcatccaggaggccctcgaccgcgccgcatggcagcactcgccgggaacgtatcccttcaccgtcgatcgttggacaccggacaaggtgttctcgggcggctacaaggcgtgggcgctgacgcccgacgagctgatcctgtacctgccggattacccggtcggccacgactccccgatccagtacgggcaatccgagcagtggtcgatggacggaggcaccgcccagccgcacatcccactcggcgtgcttgccccggtgctgcggccggaattcggcggggcgtaacggggtcggcggccagtgacctcggatatcacgctgcgcccaaccgggtgcgctcggttcaccggctgcgcccggccggccgtccaccaatcgcccggtcagcggctgctgcggctacggtgatctgtatgccatcggccagccgagcgtccgcggatccggtgaagcggcgcccgaaggatcgcaaggtccagatcgcccgggccgccaccgacgcgttcagcgagctcggttaccacgcggtcagcatggagaacatcgcggcgcgggtgggcatctcggccgccgccctgtaccggcattcccagggcaaatacgacttgttccgtgaggtcttcctggcgctgggccagcaactggtggacgccacggcgttcgccgacgacctgcccgccgacgccgatccgggggaaaccctgagcgcgctcaccaccgcgctgatcgacaccaccatcgtcaaccgcaccgccggcgggctctatcgctgggagggtcgctatctgcgcggcgacgaccagcgcaagctggccgagcagatcaaggtgatcaaccggcggctgcagcgtccgctgatcaagctccggccgaaactcacgtcgcggcaacgctggatcctgtcggcggccaccctgagcgtcatcggcagcatcaccgaccaccggtcccggctcggcaacgccgagatccgcgcgacgctgagcgacatcgccgccgccgtgctgaaggccgagctgccgacacagcggggccgcggcgccgaaccggcgcgggcgccgacgctgaccagcgccgccggcagctacgaactgctgctgcacgaatcgatgcggctgttcaacgagcgcggctaccgggaaaccgggatggaagacattgccgcggcggtcggcatcccggttgccagcatctaccaatactttccggggaaggccgcgatcctggcggtctattaccggcgcgccgccgaccagctctccgccgacctgtccagcatcctggccaccagcagcgacccggagcaggcgctggcgcggctcatcgaggcctacgtcacgcggtccttcgccaaccccgagctggcgtgcgtgtactacaccgagcggcacaacctgccggagacagacgcggtgctgctctacaacattcagcgctccaccgtcgaatcctgggcccggctcgccgtggcggccagaccggaactgaccctgggccgcgcccgctacgccgtgcacgccgcgttcgccctggcggtggacatcggccggctggtttaccccaacaccggcgcgcccgccagcaccacggttcggcggctgatggaggtcaccgtgctgggacgacccgcggccgcatcgcgcgacggacttcgcggcgccggccggcaacgccgctgatgggttggcgaaccacgctccacttttcggccggctcaggcgcgcggcggcaacgcctgttcccggaccgcccatgcggccccgcatcttcggttgcaccgggccgatggcacgggtgacaagtatccccggggtactaccggactgtgcgaacggcgattaacataattgccgtccagtccgcagcgcccgcgggaaggcaggcccatgctcagcacgattcgcaaagtcctggactatcagttgaccatcgccgaactgctgggcctgggcatcctgctggggacgccgtacctgatcgtcggcgtcatctggtcgagcacccacacggcgcatctgcacgacatgcacggggtcgatctagtggtgtcgttcctgggttcgatcgtgtcctggccggtgctgctgttcgccaacgtgtgcatgacctagggggtggcgtgatgcaccgcggtccgctgatcgtcttcgcggccgtggtgtgcctggccggcggcctgctggcgctgcggttcccggtcttcatcgatgcctacgatcagttcggcctgcaggtcaagtgcggcagcggcttcacgacggagctgacccaggcggcgagcgtggtcggcccggcgggcaccaactacgttgaccaatgcggtagcgcgctgatggtgcgacggctgtgggccattccgaccgcggttctgggcgggatggcgctgacctggcaggcggccgcggcgcttgcccatgaccaccggcggccggcgccgtcacaatccgcggcgcaatccccatcctgagtccgacgccttgttagacggatcaaacacgttgcgaatgactggctttcgctgactatcgtgtgctctcctcgggaaggtcgtgccgagattggtgcaatcccgggccgtccggatcttcgtcctggtgatcgagttgttcctgcagcttgcgctgttcctcggttgccttctgagcgtcctcgggcctagcgggtgggtcggagttgacttgctgatccaccgagatctcctctgaacgtctgcactgcctccaatcaggatctcccgaatggcgggccccgaaacccggcgaatgccgtcgaagccgatcgccctgctcacggtgcgtggagtcagtattgcttgaccaccgcgcgcggtgccgttcgccatgtcctgccgccgttgttctgttggcgcggcggctcgaggagcaagacggcgagcccgtcgagcaacaccgggcgtacccagtcgcccagttcgatcacctcgccggaacggggctgacggtacatggcgtcgcggacgaggtcgatgggcgccgtggcgaaaaccgtctccacggtggcccggtcgggcagctcgcggatgccgggcaacgtgatgaacagcccgtcgttgccggacaaatgcagtccgaccgccgcgagcgcgccggtcatgccctcccgggtgcctccgtgaccggacagatgcacacccaccgccgcggcgagttcgcggccttcgttgggatgcaacacttctcgcttagcgcggcgtccgaattcgatcaggcgcggcgcggcgccggcgagttcgcccggaacgacgacggccagcccggggtccgcatcgggagggcatacccgttcgaggaatcgcccggcgagttcgatgatcccggttcgcgccgcgtgtggatcgccgtcggggctccgccaggccaggcaggcgctcgagttatgggacgtatacgggatccggtcgtcgaccagcagctgatgacgcgtggcgcccgccggggagccaaggcccgccgcccgcaactcgtgcagcagggcccgggcccgccggcccgtgccgggcgtatagggattatcggtgtcgtcgatgccgatcagcaggtccacatcggccagcgcggcccggccggtcatggattgatcaccaggtcggtcacatcgcgaacccactgatcacggccgagttttgcgccggtgagcttgagtgtgtcgcgtttggtgaagccgagaatggtccgatcatcgagctcggccgccgtcagggactgggccgggtcgcggccttccacccgcacccggacgacgccggtcgcgcccgcggcattgaggatcgaacgcacgctgggtcccttctggatttgtgcgccgtgtgattgcggcgtctcgacctccacctgagggagctgctgaagctgcgagatggtgaatcgttgcagcacgtgctggttctcctgcacgaccagttgcagcccgcccgacccgccgcatgcgacgagcccggcgctcacgaccagaaccgcaaccacccgagctacccgtctatttctgcgcatttacggatcccatcctgtgaatacgccgtaaatacggataagtgtaggtcctggccgcttatgatccccgcatgaccgtgatgcagcgaccggcgggcgggctcactggcgtccgggaggtggcgttccccctgctcgcggtcggcatcatcgtcgcctgcaccgacgtccggattccgctggctctgccgggacaccgcgggttggtctggctgaccatgctggcggcggttgcgctggtgacggcacggcgcgagacggtgctcgcggtcggtgcggcgtcatcgatcgcggcgttgccggtgcacgggttgaccgatccgttgtggagcagtcgctatgtggccgccgccgtgttgctgtatgccgtggcttcccttcccgcggtgcggacgcgccggtggatactcgcggtcgcagccgcgcccgttcaccttgtggcgcttgccagttcggtcttgacgtggcactccggagccaacctgtcagcctgggcatcgcacgggatgctcgagcgggggggctggcatctggttttcgggttcgtcgccggcctgctcgcctgggtggtggcgcttggtctgggtcgcccgccgtcggtgcgggtcggcgcatatggaagccgatactaaggagcggccgctatgacgctgcgagttattcccgagggcctggccgcgacgagtgcggcggtcgacgcgatcaccgctcaactggcggccgtgcatgcggccgcggccccggtggtctcggtggtggttccaccggcagccgaccccgtatcgctggctgccgccgcggtgttcagtgaacgtggcagccagcattcggccgcggcgaccaagggtgttgaagtgttggggcgggccgggttgggggtgagtctggccggcgtcaactacgtcgccggcgatgcggcgtccgcgtcgacctacctgagcgcgggctgacgatgaccgcgccggtgtggatggcccttccgccagaggtgcactcgacgctgctgagcagcggcccggggcccggcccgctgctcgcggccgcagcaacctggacggggttgagcacccaatatgattcggcggcaaccgaattgacggccgtgctgaccggctccatgccggtctgggacggcccgaccgccgacaggtacgtggccgcgcacatgccatatctggcatggctccagcttgccggcgcgttgagcgccgaagcggccgcccaacatcagggggtggccaccgcctacaccgccgcgctggccgcgatgccgacgctgccggagctggccgcgatgccgacgctgccggagctggccgccaaccatgcgacccacgcggccttggtggcgacgaatttctttggggtcaacacgattccgatcgcggtcaacgaggccgactacgcgcggatgtggactcaggcggccaccaccatgaccacctatcaggcgacgaccgaagccgtgcaaatgagcagcgtcgccgggtcgggcaccggaggaaggccggcagcggcagcgggtccggaacgggagcgggcacggggaccggaacgggcaccggcactgggaccggaaccggcaccggtacgggagccggaagtggcaccggcggtgggaccggcgccggcggcggcggcggtacgggttcctttcagctgcccaccccagaagagatctgggagatgctgttcgggcccgacggtgagcagatccccggtcagggccagccgaactggagcccgtcggagtacctgcagaatctcgggaatttcttcaacggcaacgctcaggccgtggcctggctccagcagaacctttcgggcctgctcaacccgtcccagttcccggcgctgatcaactatttcatcgcgtggcagacctaccggatcatcaactggaccatccgaacactgcggttcatcctccaagaattgccgctgctgctgcaggtcggcttgagcctgtccatcaccagcctgggaggaatggccggactggcgggcctggcagggttggccggattggccgctccggcgagcgcgccggcgcccgctgccatgccgcagcccgccgcgatgggcgcgcaaccgccggtggtgtcggccgctccggcgatggctccgatggccccgaccagcccggtagcaccggcgacatcggcggcgtccacccctgcgcccgtagcctccgcgattgccccgccggcgaccccgcccgtccccccggccccggtgaccggagccgagggtttcggctacatggtggggagcttcgggctcggcatggactcgaaggcgcaaacccgggccagaagcgcgctagccgccgggcggccggcggcctcgagcgccggcgctgcggcggtcgagcaggagcagggacgcacccgccggcgtccacgatcggtcatcgaccccggataccgctacgaattcatcgagggcgacgacgaagtagtagcggtcgcatcggcagcacaggaccggtatcggccgtcggactccggcgggtcgatacagggcttcgccggcacgctgcccaagtcgggcgtgcgcgcttcgggtctgaacacgttggccggcaacgaatccggcgacggcgcccgcataccgatgctgcccgagagctgggaaggcccgtaagccgcgcgctccgcggtgcggtcagccgaggtgcgccgacagcaaccaggcgcccacggacttacgtccgttgtcctcgtcgcgaatgtcggcgccggcgaatgcctcgaagcccgccaggaagttctccggcacgttggcgtgaatgcgcgccggccggatctcgtcgatcacccagtacttgccgaccacctcgcgcagctcgtcctcggtgaccgcgttgaccgggccctcggccggcatcgcgttgcggtcgaagaccaggacgaagtacgacgcccccggcgcggcggcccgcacgatcgatcgctgatagccctcgcgcagctcgacgggcatcgaatggaacagggtgctgtccacgatggtgccgaaacgaccgtcgtagccggtgaagtcgctgatgtcggcgacctcgaagctggcgctggtcaggccgcgacgggcggccttctcacgcgccagcttgatcgcggtgggcgattggtccaggcccaccgtggtgaacccgcgctccgccaggtacagcgagaccgcggcctcgccacacccggcgtccagcacgtcgccgtggaacttgccggcctcgatgagggccgcgatctcgggctgcggttcgccgatgctccacggtggccgggcgccctcgcccatctcgggtgactcgccccggtaggccgcttcgaacatctcgtgcgttggttgagacatgcccactttatatcaactagcctgatatatgtcaacgcacctgatatatggtgcaaggctgttgcgcccgagtcgtgcccgaaacggcaaccagttagctgatgtaagcgattggctttcactgcacgcgcccgtgacaatgctggtatggccgacgacatcgaactgagccccaccgactgggtgcgcgaacagaccgaacggattctgcggcagggcacgaccgacggggtcgaggtcttcgaccggcccgtcgtgctggtgaccatgaccggggcgaagtcgggcaagaggcgctacgtgccgttgatgcgggtggaacacgacggccggtacgccgtcgtcgcgtccaagggcggcgcgccggaacatcccgcgtggtacttcaatctcaaggcccacccggaggtgacgctgcaggacggcgacaaggttgtcactctgcgggcgcgggagctggccggagccgaacgcgagcagtggtggcgacgcgcggtccaggcctatcctccctacgccgagtaccagacgaagacggccaggcagatcccggtctttgttttggagtaatccaaaaacatttggattcggtatgcgcccggccggtccggttgacccgttgtcgggcgtccacccaccttcgtacccagcggccgaggtccggccagctggacaacgacgttcctggtatctgtaatcgcccgcgctgtacggatattcgaaccttcggcgtgtcgttaccgggtggatatccaaaagcccaccgccattgacgaattcaggggagggccccatgcaacgagccggatcaccagagcggcaaggtgtgtcgacgtcgcgaagcgaacggctccgtgaggtgctccgctacgatctgcccgcctcgttggtggttttcctggtggcacttccgctgtcgctggggatcgcgatcgcttcggacgccccggttctcgccggcctgatcgctgcgatcgtcgggggcatcgtcggcggatggctcgggggatcgccgctacaggtcagcggacccgccgccgggctcaccgtcgtggtggccgacgtggtagccgaattcggctggggtgtaacctgtttcatcaccgtcgtcgcgggagtcctgcaggtcttgttgggattcagcaggatcgcccgcgccgccctggccatctcgcccgtcgtggtgcacgccatgctggccggtatcggcatcacgatcgccctgcagcaggtgcacgtgctgttgggcgggtcatccaagagttcggcctggagcaatgtcaccggcctgcccgcgcagattctcggtgcgcaccgcccgggactggtgttgggcctgctggtgatcgcgatcctggtggcctggcgctgggtcccggcccggctggccatcgtccccggcccgctggtcgccatcgtggtggtcacgatcatctcaatggtgctgccgttcaaggtatcccggatcgagctggacggctcggtgctggacgcggtgcggttgccgtccctgccgcacgggaattggggggccgtcgcgatcgccgtgatcaccgtcaccctgatcaccagcgtgcagagcctgctcaccgcggtgtcgatcgaccgcatgcacaccggcccccgaacagatttcaaccgcgagctgatcggccagggcgccgcgaacatcgcgtcgggcgcgctgggtgggctgcccatcgccggggtcatcgtgcgcagctcggcgaacgtcaacgccggtgcgaaaacccgcgcttcgaccatcatgcacggtttctgggtgctggtgttcgcggtgccttttgccgggctggtcgaaaagatccccaccgccgcgcttgccggcctgctgatcgtcatcgggatcgagttgctgaagccggcgcacatcgaaaccgctttgcgcaacggcgatctcgccatctatctggtcacggtcaccagcgtcatcttcctcaacctgctgcacggcgtgctgatcggtctgctgctcgccgtggtggtgaccgggtggcgggtggtgcgggccaggatcgaggccgaaccggtgggcgacggatggcacgtcgtcatcgagggggcatgcaccttcctggcgttgccacggctgaccggcgtgctggcctccatccccgagcgcacctcggtgaccgtgcacctgctcaccaactatctcgatcacgccgcgcatcaggcgatcggcgactggcaacgacggcactgcgccaccggtggaacggtcgaggtccgcgacacggccgagccggcggcgcggcgccgcaactcgcacctgagcctggtcgagcaggtctcttcgcccgggggtgcgtgacctccgcgcccgggggcgcgtgacctgcgcgcgctacctcaggtcggcggccacccgctccagcgcggcgaggtggtcgtcgacgccggcgaacccggccttcatggtgttcaccgaaagatgcgtggccccagcggctttccacgcggcgatgtcgccggccagcttgtcgcggtcgtcggtccagctgacccggccttccatcccgatgctcgtggggtcgcggccggccgcctcggccgcgcgggtcacctgctcgagcgcgtggtccaggccgggtcccggttcggtcatcgggaaccagccgtcgccgaggcggccggcgcgttcgaaggcgcgatcggaggcggcgccgaaccacaccgggatcggccgctggaccggcagcggggccagtcccgccgcggtcacggtgtggtatttgccgtcgaaggtgaccgagcgttcggtccacagcctgcgcatcagctcgacctgctcctcggagcgcttgccgcgattggtgaacgtctcgccgagcgcttcgtattcgacggcgttccaacccaatccgatgccgagccggaagcggccaccagtgagcaggtcaacctcggcggcctgcttggccaccagcaccgactggcgctgcggcaggatgatgacgccggtgaccagttccagcgaggtgatcgccgccagatagccgaacaacacgaacggctcgtgaaaggtcgagtcgatgtcgtaggggccccgccacccccggtgcacccgcgggtcggcgccgacgacgtggtcgtaggccaggatgtgggtgaacccgagctcctcgacccgctgcgcgtagctgcgcagcaccgcggggtccgatccgatctcggtctgggggaagacgactccgatgcgcattcgcggttcaaccgcgtcccgacgcgattccttcccgcatcgccgcgtcggcgatgatggaggcgtggcggtgacaaagctcagcggcgtgttccgggtcggcgaattggagccggcgttcgcagaagagctggccgcgcgctacgacgtcccgagactgcccgacggcgccgcgcgcgaccggttcctggccgagcacgccgccgaggtgcgggcgctgctgacctggggacggcccggagtggacgccgccctgatcgcggcgttgcccaacctggaggtcatcgtcaacaacggcgccggcgtggacctgatcgacaccgcggccgccgaccgccgcggaatcggcgtcagcaacaccccggacgtgctctccgataccgtcgccgacaccgcgctgggcctgatcctcatgacgctgcgccggttgggcgccgccgaccggtatgtgcgggccgggcggtgggcgcgcgaggggccgttcccgtacggccgggacgtcagcgggctccaggtcggcatcctgggcctggggcgcatcggctcggcgatcgctaccaggctgcgcggattcgactgcgccatcgcctatcacaaccgccgccgcatcgacggctccccgtatcgctatgccgcctccgccgtcgagctcgccgaatcggtcgacgtgctgggtggtcgccaccaccggcgaccaccaggcccacaaactcgtcgaccgcgccgtgctgcgcgccctgggccccgagggttacctgatcaacatcgcccggggcagcgtcgtcgaccaggaggcgctggtggagatgctggccggcggtgaactggccggcgctgggctggacgtgttcgccgacgagccgcacgtgcccgccgagttggtcggcctggacaacgtggtgctgctgccgcacgtcggcagcgccaccgcccggacccggcgggcgatggcttcgttggcgctgcgcaatctcgacagctacctggccacgggtcaactggtgacgccggtgctgcggccgcgccgccggattccggaccgcaactgatccgtggtcgaagcgatacccggaaaaggttatcgccgcccccgcaacggggtatgcggcactcatgagcccactaccgtcgcagactgccacgccggtgcggttgacgctggccggcagcgcccgccccgacaccgtgacggcgtggcgccgtgccctgcaccggtggctgcagcacgaggtgcgggcgcccgacgacgtgcgtgacgacgtggtgctgggagtcaacgaggcgctggccaattgcgtcgagcacgcctaccgctcgcaccgcggaaccggcgcgatgaagctgcaggccagctacgacccgggcgccgagtcgatccgggtgtgcgtgagcgaccgcggccggtggcagagcccgtcgtgccggctgtcgagcgacccacgcgcgtcccgcggcatcatgctgatgcacaacctggccgagcactgcaccatccacgcccgcccggacggcaccagcgtctacctggattacgctctcgacccgaatcccgttggtgctcaacgggtttgaaggcgattagctgcctacgggtgccgacggggtgaacttcaccggcaacgggtcgtcgcaggccagcgccatgtcgggcagacagtgctgcaccgcaaaccggccgggccgcaacgggtaagcggcgcagcgcttctcagacgccggcggccagctccaattccttcaaggacgcctccaggtggccgagcatccgctgcagatgcggcacgctgcgccggcagccgacgaggccgaagtcgaggttgtcggcgttgttggtcacggtgatgttgaccgcctgaccgtccagcgggatggacagcgggtagttgccgtccagccgggcgccgcgccagtacaaccgctccgagcggccggtcgacacgttcgagatgacgatgttgaacggcggcgaggccgtcgacaggtagccggggatcagcccgaagaacagcccgccgatgttgaaggcggacagcgccaactgctgcaccggcggcagctgccagaacacctccttggtgtcgcggatcgacgcgctgatgatctccagccgcttggcggggtcgtccaggtcggtggcgaggttgcacaggaaggtgccgaccaggttgccgccgcggtcgtcgtcgggcttgcgcaggttgaccggaaccatcgcggtgagcggggcgtccggcagggcgttctggtcgagcaagtaggcgcgcagcgcgcccgacgacatcgcgaggatgacgtcgttgaccgtggcgccggtggcagccttgactgcgttgatgcgctccagcggccaggactgcgcggccacccgccgagcgccgccgatgcggacgttgaacatcgagcgcggcgcctgaaacggcagggtgagctgctgttcgagcaacgcggcccgggcgagcttcagcgtggacggcgccagggcgagcgccgacccggcgatgcgggcggcccgctcgagcagcgacgggcgtcggcgtgagccgcgctggcgcggcgccaggctccagggcacccggacctcgtcgtcgtccggatcgggggtgaaggcccgctgcaccagccgcagcgcggacaccccgtccatcagggagtggtggtacttggtgtagacggcgtaccggccgtcctggaggccttcgaccagatgggcctcccacagcgggcggtgccggtcgagcaggctgccgtgcagccgggacgccagctccagcaggtcgcgcacccgtccgggttcgggcagcgccgagcggcgcaggtggtagtcgagctcgatctccttgtcgaccgaccaggccaggttggtgacgccgccgaagaacgctgggtgcttgcggaaggtgggctgtacgtcggtgcactcgagcatcgcctgatagctctcgcgcacgaaatgcgggccggcgtccggcggcggctcgaagagctgcagcgagcccacgtgcatcggatgctcgcgtgactcgccgatgaggaacaacgcatccgtcggtgaaatcggttccatggttgtcgcacccgcctgtcgcctctgtcgcctgtggcgccgtgatcgccgcccgcggtctggacggcctacctcctaatagcccgagcgcgcgtcggccacacccgaatggtcggtgtctaacgcccggtggcctggaagatgacgcgccgcgcgatctcgacggcgtggtcggcgaagcgttcgtagaagcggcccagcagcgtggcgtccaccgcggcggcgacgcccggcgtccacgccgggtccatcagcaccgacagcagccggcgatgcaactcgtccatcgtgtcgtcgtcgcggcggatctgcgccgcccggcgcgggtcctgggacagcagcacctcgcgcgcaccggcggccagcgcctcggccgcctcacccatggccgcgatgatcggccgcacctccgccggcacggcgctgtcggggtggcgccggcgggcgatctcggcgacgtgcaccgccagctcgaccatccgctgggcgtcggcggcgatccgcagcgcgctgaccaccgcgcgcagatccgtggccaccggcgcctgcaacgccaacaacgcgaacgcggtctcctcggcctgcaggcccagggcggcgatgctgtgctggcgggtgatgacgccctcggccgtcaacaggtcggcgtccagcagcgcgtgggtggcctgcgcgatcgcgtcggcggccattgcgcacatctcggcgagccgcgcgttgagcaggcacagccgccggtggaaaccggacctcatccgtgacggataacccgtcaccgccaaataaacgtgtgcgcgataaacgtgcccgggctagcggacgtcgtcggccagcgcgcgggcctcccgttcggtttccaccgcgggccccgagcccggcaacggtttgccggcgacctcgggggtgaacagcagcgtgacggcccccaccgcgccaccgaagatcagcatgtaggccggcaccatcacgttgccggtggccgacaccagcgcctgggcgatcagcggggtgacgccgccgaccagcgatatcgagatgttgtaggagatggccagcgccccgtagcgcacgttggtgggaaacagcgccggcagcatggccggtccggtgctgtcgaagcacagttccatcagcccgatcagcagcacgccgatgaagatcaccggatacacgccgccgaatcggatcagcaggaacgccggcaccgaggcccctatcagcagcgcgcacccggtccacatgatgggtttgacgccgatgcggtcggacaggctggcgacggccaccaccgtggccatcaggatggccagcgtggtcacgatcatcaccagcccggccgtgtgtccgacccgcacgaacagccggagataggtgggcagatagccggtgagcatgaagtcggcgacctgggaggtcagcaccagcgccgcgcagatcagcatcggccgccactgctgcgccaccgtgcgccggatctgttggcggccttggccgcccggcgtgtgcgggctgtcgttggcgctctggtaggccgaggactcttccagccgcagccgcaggtacagcgcgaccagaccgaacggcagccccagcagcagcggaattcgccagccgtagctcagcatgtcctggtcgggcagccaggtctgcagcccggtgaccagcatgccggccagcacgaaccccaccagatttcccatcggcaggaagccgaccatcatgccgcgcttgtggtcgggggcctgctccaccaggtaggtcatcgcgccgacgtactcgccgccggtggacagaccctggaatatccgggcgatgacgagcaggatcggcgcccagatgccgatgctgctgtaggtgggcagcaggccggtggtggtggtgctgaccgtcatcatcaggatggtgacgaccagcacccggtggcggccgatgcggtcgcccagcgggccgaagatgaacccaccgagcggacggacgacgaacgccgcggccagcgtgctgaaggtcgcgatcaggtgcaggccgctgacgctcttacccggatagaacacctcggcgagcgtggtcgcgatgtacccgtagacaccgaagtcgtaccactccatgaagtttccgatcgcggtgcccatgatggtttgacgcatcgctggatcggcgaccctgatttctttacgtgcccatttcctccggcggcggcgaatacccattgactgatggcttacccgaaactttccgggcacgaaccagcgggggtgggctaacagcggtgaccgcgctgcgaccggacccggtcgcagccgctcggccacctcgggcgacacgcgccgcgggggcgtcaaaggccagctagggcggggtactgcggttcggcggcgacggtgtcgcgcgcggtgtgcggcggcgtccggttattcgcgtcacgttcggctcgatcgggccggtcattggcccttgaggctgccgatgcgcagcgagaagtcggccggtttgggcggctgggcgtcctggagctgctggacgtaaccggccgggtcgcgatcgatgatcggcaagccctcggtggtgggatgctcggccatgaactcggcgtactggcgcccgagcgcttcgcgcaggccgatcggggcggtgcgccggaaatccgacagcccttcgcgttcctcctcggccatgtggtcgtcgttggcctcgcgggtgcgtcccaccgcggcccaccactgctcggtgcccggctgggccgcgttcgccgcacgcaccccgtcgcggatgtcgttgtgatcgccgatcgcgtcgagggtctcgccctcggcgtccgcactgccgcgcttgagcagctggggatagaagatcttctcctcgatgtaggcgtgcacgtcgagcttgtcggcgagcggccgccacacccgctgcagcgcgtcccggtcgtcggcggcctgggcctgcaggtagtcgagccgggcgaactgctcgcggaaccagtcgtggtcggcgaggatcagcatggtgatgtcggccatccgcgtcctgccttccgccggtcgatctgggctggcctacccggcttcccggcccggctaacaccgcgccccgaggatcaacccaattgacgcccaggtaagcgatctgccggccgggggccgccgacgcggcggatacactgaggcagccgcgaggcgaccggccacggtcgcgcccgtcaaacccgatcagaataagtcagaggttgtgccttgtccgagaacaccggcgatgccgtcaacttgcaaccgcatttcgacgacgtccaagcgcactacgacctgtccgacgagttcttcgcgctgttcctggacccgacccggacctacagctgcgcgtatttcgagcgggacgacatgacgctggaagaggcgcagatcgccaaggtcgacctgtcgctgggcaagctgggattacagccgggcatgaccttgctcgacatcggctgcggctggggcaccacaatcgtgcgcgcgctggagcgctacgacgtcaacgtcgtcggcctcacgctgagccgcaaccagcaggcgcacgtgcagcgccggctggacaaccatccgtccccgcgcagcaagcgggtgctgctgcagggctgggagcagttcgacgagaaggtcgaccgcatcgtgtcgatcggtgccttcgagcatttcggccgcgaccgctacgacgacttcttcaagatggcctacgcggcgctcccggacgacggcgtgatgctgctgcacaccatcatcaagcccagcgacgaggagttcgccgagcgcggcctgcccatcaccatgaccaagctgcgcttcatgaaattcatcatggacgagatcttcccgggtggagacctgccccaggccaagggcgtcatcgagcacgcgcagcgggccggcttcggtgtgcagcgggtgcaggcgctgcgcccgcactacgcccgcaccctggacacctgggccgccgcgctgcgggcgcgccgcgacgaggccattgcgatccagtccgaagaggtctacgaccgctacatgaagtacctgacgggttgcgcggacctgttccgtgagggctacaccgacgtcgcgcaattcaccctgaccaagggctgacgtcgggcctgcgcccggcgcggtttaccggcgcattccggtaggtaactccacggcaataccccaatccccgctttgcgcagcgtatttcacggtcaacgaccgggtggtcgcggtcgcggcctgaccgcgattggccgaatcttcctgcgcgacgggtgtttccattaccctgatagccgatccggccacgggaggcgccatgagcgagcacgaagcgaagatgatcatcttgtcgaccgacgacctggacgagtcgatccggttctacagcgagaccctgggtatgccgctgaagttccgcgacggggcgcacttcgccgcgctcgacgcgggcccggtcaccctggcgctggcgaccgcggtggaccacccgatccccggccaggtggtggtgggcatcaagaccgccgacgtcgacggcgcggccagggccgtcgaggccagcggcggcggcatcgtcaagggcccctacgacgacgctcacgaacgacgcgccgtggtctatgacaacaagggcaacggcctggtcttctacaaaccgttgggccggtagcggcgctcgcgcgcgagtgccggcgcgcgactactttccggtgcgctcgcggtgtttgcaccccggccagcagcagggccgccgcttgccttcctccaactcctcgacggtgcggcggatgcggcgctcccgggtcgcctgctgcttggcgtcctcgacccagcagatgaactcgtttcgggccagcggcgtgatgtcgttccacgcggcgagcgcggtggcgttgccgatcaatgattcgcgcaggtcggcgggcagcttgtgcaccaccccgccgggcagtggccggccgctcatcgggccaccaaatgcgcgctgtcgtcgtgtaattcgtcgcggcgcaacgtcatcggggtggcggcggggatgtcgccgccggcgatcaccgcgcgggtgatcggggtgagcgcctcgaacagcgtctccacctcgtcgtcggtcagcgcgctgagcgccgacagggccagcgcgtcggtggtcgcttcgatgtggtccttgcactgtcggccggcggcggtcagcgcgccgtcgccgtcgagcaggccgcgctcggcgaggcgctgttcgtgccggcgccaggatgcctcgtcgtaatcgcgggtgcgggcgatgtagtcgcgcgacacgttgcccgccgcggcgtgcaggacgttggactcgcgaccggagatgccggcggcggccagcaccgccacgtgcgcgtcaccgcgctgctcacgcaacagcgtcgtcgcgtgccacagcgcggccagcggatcctccggccagggcagcgccagattggcggcgaacagcgggcgcccgtccagcggtgctccccgggccgccttggccgcgagttcggctgccacggcgacgttttcatccgggtgcaggccgtagcggcccagcgcggcgaccgcggactcctgccgcgcccgaagcgcggcctgcgggcccgcgatctcccaggccgccggcagggccttggccacccgttcgggggcgaagttgtagaagatcgcggccaccacctcgcgcggcaccgcacccagcggcgccgagcgggccgcgaaatagcccatccagaatccgcggtagcccagggcgtccagcgcggcccgcgcctccggcgcgaagtacgtcaccgcgtgcaccggctcgtagcgatcgaagaagcgtcgggccagcagcggttgtcgtcgcatgctggcagttaaccattggttgccggacccaccaagcgcgaatccccggcgtcggagtcggcgtcggtggtcgggagccgtcgtgcgatgacggccagcgcgtgctcggcccagcgaatgttgtcttcctcgaaggagattccgcggatcagcgtgaggtacgggccgatccgttcggcgcgggccaggtagtcctcttcgctgcggccgtccagcaggcgggcccgcagtcgttggtagcgcgccaatttcgcggtggcccagtcccgtcgctcgcggatggcgtcgcggaccgcccgcatgtcgccggcgtcggcggcctggaccttgatcagcagttcgtcgcggatcaccgacggcctcggcgccgtcgcggtgaaccgccggatcgccgcgcgcccggccgcggtcagcgagaacatgcgtttgttgggccggcgctgctggtgcaccacccgcgcccggatcaacccctgcccggccagccggtcgagctcccgatacagctgctgaggggtggccggccagaagttcgcgaccgaggcgtcgaagtccttggccaggtcgtatcccgacgattcgccctccaggagggcggccaacaccgcgtcacgcagcgacaccggacgatcatacaaccacacgaataatcaacaaagtgactaagcgcacgctggacatatgcggccgatcggcctagcgtcaaccccacgtactcaacaagttgactatgcgaggtcgccgatgcatccgttccgccgggccgtcgaagagcgcgacgagcaggccatccaggcgctgctggccgacactgtggtgttcaccagcccggtggcgttcaagccctacgtcggcaagccgatcaccgcggccatcctgcgcggggtcatgcggatcttcgaggacttccggtacctccgcgagatcggcgacccgggcggccgcgaccacgccctggtgttcgagaccggcatcgccggggcacccgggatcaggatcaccggctgcgacttcctgcactgcgacgacgacggtctgatcgacgacttcatggtgatggtgcggccgctgtcgggtgcgacggcgttgtccgaggcgatgggcgcccagttcgcgcgcatccagcaggaggcggtcgaattggccaatcgattcggcaccgcgtagaagtagtgaccatgcggatcggattgagcatcaactatgcgggcggcttcaaggacgtggccgccgaggtggccgacctggaaaacgccgggctggacatcgttttcgtgcccgaggcgtactcgttcgacgcggtgagcgcgctgggctacctggcggcgagcacccagcgagttgagctcgcgtcgggcatcctgcagctctacacccgaacgcccaccctgaccgcgatgaccgcggccggcctggactacgtctccgacggacggttcaccctcggcctgggagcgtcgggtccgcaggtgatcgagggcttccacggcgtgccctacgacgccccgatcgggcgtacccgcgaagtgatcgagatctgccgccaggtgtggcggcgcgagccggtgcagcaccggggcaagcactacacgatcccgctgcccgccgaccggggaacggggctgggtaaaccgctcaagctcatcaattctcctgtccgcgaacggattccgattctagtggccgcgctggggcccaagaacgtcgagatggcggccgagatcgccgagggctggcagccgatcttctatctgcccgagaaggcgcgcgacgtgtggggcgagtcgctggccgccggccgggccaagcgcgccgccgagttgggtgagctggagatctacgccggcccggtattggcaatcggcgaaaacgtggagccgctaagggaattcgtcaaaccgcacctggccctctacatcggtgggatgggcgccaagggcaagaacttctaccatgcgctggccaccaagtacggatacggcccgcaagccgaccggatccaggagctctacctggccggcgacaaggacggggcggccaaggtggtgccggatgatctggtgcgcgacgtgaacctgatcggcagccgggagttcgtcaaggagcgggtggcggcgttccgggaggccggggtgaccaccctgaacgtggcgccgatggcgtccacccccgccgagcgggtcaagctgatcgaggccctgcgccaactggtgtgacgcgcgtaccgggcacgcgcgtcggctcggcgaaatcagttctgccggtggtcatctcgtcgcagccgggccgctctgccgaccgccgccgtcatggccagcaccgccatgccggacaggatcgccgtcgcgaccccggggcgaacgctggccagtatcagcggcagcccgaagccgatgtaggtgaccacgtagaacagcccgtcaggccgccgcgcaggcgttgcggcgcggcggcctcccagatcgatcagcccttcgcgcagacacaatccggacgcgcaccccaggaccacgaacagcggtacgcccagcgccggggtcagggtgggcggcgccgcggcggccaccgcgtaaccgagggcggccagcaccgcgccggcggtgccggcctggggcccccagcgcagcgcccgggccagcacctggaccgcgccactgaccccgttgacgatcagggtggcggtgccggcggccaccggagcggccaacgcggtgtgcagccggccgggaatggtgacgaaacccaatgtggccgaggcgaacacccacggcgccagtggcatcgcccaactcaacgcccgggaaatgccctgcggcgcagcgtcagccgtctcctcgccgtcaggatccgccggcgccgtcaccggggacggctgcggggcggcgacgacggcgaacgccgccagcgcgaggatcgcggcggcgagcgcgaacgacgcccggacgccggagggtccggcccaggcgcgcacgcccccggcgaacggccccacggcgaaaccggcggtgagcaccgctccggcggtcgcggcgccggcgggacctctcagatcggacgcccaggcggtgcccgcgctgatggccaggcccacaccgagcccgacgatcaggcgccctgcgaacaacgcggggctgtgctgggacagcagcatcgccaccgtccccaccagcgcggccgccgaaccggtcagcgccaccggccggcgcccgagcgcgtcggaggttcggccgccgaccagcagcccgggcagcaggcccagcgcgtagatcccgaagatcccgtcgagcgtggtggtggcgaggtggtcgcggtcgctgatcgccggcatcagcccgacgaagtgattggcgacccagcccgtggccagcagcaggcccagcacgccgacgaacagcggtgcaccggtgggtggctgggggtccgttcggccggggcggttgcgggcggcgcgcacgttcgacgacatcactgacggtagtaacacacggtcaccgggccggctattcccgcgccggccgacggtcccgccgcgggccggcgtgcaaacatggcttcggtcggtgcgcaccgcaccgcggggtttgaaatcaggcaattcggtgtacagataccactactcgtcccgaggaaggcaaatgatgaagtacattgcggcagccgcgatcgcgctctccgtcctgctgtccagcgcgtgttcggcctcacaggtcatcaacaccggcggcgacaccaagtgcaaggacttcaccacacaggacgaaaagaagcagaacgacgaagtcagcaagatgctcaaggacaagagcggcaccgatccgagcaacgtcgagatctccgcgacgcggctgtcggcgatgacgtactgccagacggtcgggaagccggacaccaagatctccgaggcgccgcacggctgacggcggccgatcttcgaatcacgatcaccgcaaatctagtgggcgctgccgcgggttcctaggctgcccgggtggtctcgaccaacccggcgccggcacgtgtgacgcttcgccacgtcgatcggacgttcggaacgcacaccgtgctgcgcgacgtcgacgtcgagatcgaaccgggtgcggtggtcgcgctgctcggagcgtccggtagcggcaaatcgacgctgctgcggctggttgccgggctggaccggcccagcgggggccggatcgaaatcgacggcaaggcggttcgcgggatcgacccgcgctgcgccgtggtgtttcaggaaccgcggctgctgccgtggcggtcgttggcggccaacgtcgccttcggactgccgcgcggcatcgagcggtcggaaagacttgcggccgtacagcgttggctcgacgtcgtcggcctgcgcgaattcgccggccactacccgcgtcaggtctccggcggcatggcccaacgcgccgggctggcgcgtgccctggcgcggcagcccagcgtcctgttgctcgacgaaccgctggccgcgctggacgcgctgacccggttgcggatgcaagacctgctcgacgcggtgcagcaacgggccggtaccacaacgattttggtgacgcacgacgtggaggaggccgtgctgctggccgatcgggtgctgatcctgcgcggcgaggagggcggcgcggcgacgcacgacgtggcgatccccaagccgcgcgaccgcggtgatccgcgcatcgccgcgctgcgcgaacagttgttggaggaagtcggtgtgccgcgacgcggatacgccgtcgaacaggaggcgaaaacgtcgtgaggccaaggcatctgacggcattggcggtggtcgccgcggtcaccgcggtgtccggctgcggttcgagcagcggcaccacgacgaccaaggacctgcacctcgactacgcgtactacaacccgctgagcctggtgatccgcgaccagcagctgctggagaagaagggctaccacgtcacctgggtgctctcccagggcagcaacaaggccaacgagggactgcggtccaaggccctggacttcggctccaccggcggttcccccgcactgctggcgcgggccaacggcaccccgatcaagacggtcgacgtctacgcccggggcgagtggaccgcgctggtggtcgccaagaactcgcccatcaacgcagtggccgatctgaagggcaagaaggtcgcggtcaccaagggcaccgacccgtactttttcctgttgcaatcgcttgccacagcggggctttcgcccgcggatatcgagatcgtcaacctgcaacacgccgacggcaagaccgcgctcgagcgcggcgacgtcgacgcatggtccggattggacccgttcatggccgagacgatccagcagcagggctcccgcatcatctaccgcaacccggacttcaattccggtggtgtgctgaacgctcgcgaggatttcatcaccgcccacccggattccgtccagttggtggtcgacacctatgaggaggcccgcaagtgggcgaagacgcacccggccgagctggcggcattgctggcctcgcaggcgacggtgagccagagcgtggcccaggaggagctgggtcgaacggctttggacatcgacccggtgccgggggattggctgcgcgccgtgctgacccggatcgagccgctggcggtggccgacggcgacatcaaatccgacgacgccggacgcaacgcactgaacactctgatcgagccgaagtacgctcggcaagcccgctgacgccgcggtcccggcggctgggcgggctctcgatcggcctgatcgtcccggcgctgctgctggtggcgtggcagctcgccaccgccgtcacgggattctttgcgcccagccaacttccgcctcccggcgacgtggtggccgcgttgagcgacttggcgcggcacggcgaactgtggacgcacctgagggccagcggctggcgggtgctggcaggatatgcgtccggggcggctgcggggctggcgctgggttccctcgtcgggctgtcggccaccgcgcgcaggctgctggccccgaccgtggccgcatttcgcaccgtgccctcgttggcctgggttccgttgctgctcttgtggtttggtatcgacgagacacccaagatcctgatggtggccatcggcgcgttctttccggtctacacgacgacggcctcggcgctgtcccacatcgacgcccacctggtcgaggtggggcgagcctacggtcggcacggggtgtcgctgttgaccgcggtgctgctgcccgccgcggcgccggaactggtgaacgggttgcgattaggcctggccaatgcgtggctgttcgtggtggcggccgagctgatcgcctcctcgaagggactcggttttctgctgatcgacagtcagaacagcgggcgcaccgacgtgatgctgctggcgatcgtgctgctggccgggctgggcaaactcagcgacgccgcgctgggcgccgtcgagacccggatcgcccggcggcgcggctaatcgagcagcagctccgcgggtatgtcgtcggacagcgcggcccgcgccagcagttcgccgagcagcggaccgaacttcatcaggttggcgccgacgaacgccagtacccggccccgccgcgccacggtccagccgtcgccacccgaatccagccacggcgcacggacactgacgcagtccacccggtccaccgccaccagcgacgggaacagggcgcgcaccgtcgcggggtcggcgacctcctgcccgaacgcccaccgcccggtgccgccgagcggcaacccgtagccctcgggcgccgacaggcacgccgctccggtcgcatccgcgccccggtaggtgaaccgggtgtgcggcacgaagtcgacgccgagcgggccgaacagcttcggcgtcgccacccccgcgcagatcagcacccgatcggcgcgcagcacggtgccgtcggcgagcaccgtgctgccgttgtcggccaccgacaccacctcgccgcgccggatgacgacgcggcgtgccaacgtggtcagcgcgcggcggatccgcaggctgccgcccagtggatcgaaaattcctgtctcccagggcacgtcggcgaacgggatccgctcggcgatgccatcccgatccagccgggagaacgcggcgcccgcccgctccatggcctgcgcgaccccgtccgccgcggcgccggcggcgatgaagccctccgaacccagcagccgccccaccccgaactcggcctcccaccgctgccagcccgcccgggcggcaaaagccaaccggcacaacgactctcgccgatgggcgatccggaagatccgggccagcccggcggactgctcgccgaacggctggcctttttccagcacaaccacgtcgtcgtgtccgcggcgcgagagctcgtgggcggccgcgaggccgcacacccccgcaccgatgaccacgatcatcagaagaagaacccggcgtgcggcgcctcgggcaccgcgaacagccgatcggcgagcgccagcgcccccggatcgcgggcccgggccagcccggccacggcgaggtcgcgccacgtggtgccgccgagcagcacggcggccagcccctcgacgtcgacatcgacgtcggccggcccgtcggtcaccgcgacaccgccacccgcgatgcgcagtcacaccgaattgtcctgcagcagcgggtcgttgaccgcgacggtgagcgtctcgtcgccgcagtagccgcgggcggccagcgccgcccgcgcgtcgaccacgcggagccacgtctcgtcgtgtaccgcggtgacccgcaccgaccgccggtcggccagcagccagggcagcggatcgtccagtggcagcatccaaaattgcacgcggtcaaccagatccaggccgagcaggaaccgcagcaacccgaggtaggcctcggcggtgggcgcgaagaagtcctcgaccacgatggtgcgttcgtcgctgacgaaccaccgctcggtgtcgatcgggcggtaacggacgaaaccggtttcggaccccggcgcgccatgcaccgcgacatacgttggacccggggcggattcggtgcgcaaccgcacaccctgccaccacacccgcggacggtcgatggtgcccgggcgcgccgggcgatgctcggcgtagatccggggcagcacctcccacgcctgcgcggtatccagtaatcgcaccgggccgcccggcccgacgtcgcggcgcagcgccgcccgcgcggtgtgcaccgtcaccgattgcgacgagctcgcgacgccgtagccgtagcggccgtagatcgtcgcctccgaggcccgcagcgtcgccaccacctcgttgcgtgccgcgaagtcgcgcagctgatggcgcaccagggcggtggcgatgccctgccgggtgaacgacggcagcaccccgatgtgggtcacggccgcgtgacccaccagcgccccgccgggcagcgtcaaccggctggtcaccgcgtcggcggtgccgacgagttgcccgccggcgtaggccccgatcgtgcggcccggctcgagcagcgtgccgatctggccgggtgccagccccgccagcggcgcgaacccgaccatggcggtgcggaacacgttggcggcggcgatcaggtcgtcttcgtcctcgagaacccggatctcgatagccatgccgccatcatgtcgcgcgcggccggtggcgccgcccgcgggaggtcgctacccggtcaccggatgggcaggccggtcagtgcccgggagatgaccagccgctggatctcgctggtgccctcgaagatggtgaagatcttggcgtcgcggtgcatccgctccaccgggtagtcgcgggtgtagccgttgccgcccaggatctggatcgcctcgtcggtgacgtacaccgcggtttcgctggccaccagcttggccatcgagccctccgcggcgtcgaaggcctggttgttgcgggccatccagccggcccgccacaccagcatccgggcggcgtcgatacggcacttcatgtcggccagcttgaacgccaccgcctggaactcgccgatcttgcggccgaattgctcgcgctggcaagcgtattcgagcgcatactcgtaggcggcccgcgccaccccgacggccatcgcgccgaccgtgggccgggtgcgctcgaaggtcttcagcgcggcctgcccgcgggccgaggcgccggacttgacccgggcgatccgctcctcgaacttctcccggccgcccaggatgtggtctgccggcagccggacgtcgtcgagcaccacctcggccgtgtgcgacgcgcggatcccgtgcttcttgaacttctgcccctgcgccagccccttcaccccggccgggacgacgaaggtggcctgcccgcgggcgcccagctccggatagaccgacgccaccacgatgtgcacgttggcgatcccgccgttggtggcccaggtcttggtgccgttgagcacccactcgccggtggcttcgtcgtagcgggcgcgggtgcggatggcgccgacgtcggagcccgcatcgggttccgacgaacagaacgcgcccagcttgggttcgtcggcggtgccgaacatctcgggcaaccagcggcccagctgttcgggcgtgccgttgccggccagcgccgccgcggccagcccggtgcccatgatggacagcgcgattccggcgtccccccagaacagctcctcgaacaccgtcaacatgcccaggccggtcggctcggccgcctgctgggcgaacaggtcgggcgagtacagccccaccttggcggcctcctggatcaccggccagggggtctcctcacgctcgtcccattccgcggcggcgggacggacgacgtcggccgcgaactggtgcacccagtcgcgcacctcgatcacgtcatcggacagctgcagggaaaacgtcacgtctgtgctcctgaatcattgtcgttgtcgttcaaaggttttcgccggttcgtgtactgggcgaggacgctgaccgtttggttgacccaggcctcgaagtagcggtcctcgtcggtgttgccgggcagccggccggtgagcgcttgcagggtggcggcataggacagcgacccgatcgccacggcggcggccgcttcgggatcggggatgctggtccgcccggcacgattggatgcggccaattcgtcggcgaagcgttggtaggcgttgtcggtgatcacctgccaggtcttctcgtcgagatcgccgagctcgtcgggctcgcgcaacatgaccttgagcagatcctcgctctgtttgaggttgttccagatcagctgcccggcggtgcgcaccgcctgctcgacgctgcccggctgccccgcgtcgtactgctctcgcgcggtcacgatgctctcgatccggtgcgcgaccgcgcctcgagcagctcgcgcttggagccgaagtgtttgtagagcgccccggaccccggcgccaggcccgactcgcgctggatgtcggccaccgacgtcgcggcgtatcccttcgcggcgaagagccgcagcgccgcggacagcagccggtcccgtcccgagctgagcatggtgagagagtactcactcaccatccacggggcaaaatggtgcccgcgctcggcgcgcgagggggagaaggcgatgcggttagcgttagattcttgccgaactgaaggagcctgacattcgcgtcttaccgcgcatacagctgccgatgcgggtgctgtcgctgcgcaccatcgtcatcgtggccgcgatctcggtgatgaccctggtcgtcctgctgggcacatgggtgtgggtgggcgtcaccaacgaccagtacaaccagctggaccgccggctcgattcggtcagcagcctgggcgacatcagcagcctgctcaccaacccgcagcacaacagcccggaccgcgccaccccggacggcaacctggtgcgcaccgcgcgcatcggcggcgtgaccgtgtcggtgccgagcaacatcgtgttgccgcaacttcccgacggttacgccaacaccacgatcaacggggtgcagtaccgcgtccgcaccttcaccgcgggccccgcctcgatcgcgctcgccgcgccgctggccgaagcccagcaccggatcaacgaactgcacctgcgggtgttgttgatctgcgccagcgtgatcggcggtacggtggtggtgggctgggtgatctcgttgatcatggtcaatccgttcctgctgctggcccagcaggcgcgcgcgatcaacgcccagtccagcccggacgaggtccaggtgcgcggcgtgcgcgaggccgtcgagatcgccgaggcggtcgagggcatgctggcccgcatcggcaaggaacagcagcgcaccaaggccgcgctcgagtcggcccgcgacttcgcggccgtcgcctcccacgagctgcgcacgccgctgaccgccatgcgcacaaacctggaggtgctgtccaccctggacctgccgcacgagcagcgccaggaggtgatcggcgacgtcatccgcacccagagccgcatcgaggccacgctgaccgcgctggagcggctggcccagggcgagctgaccaccgtcgacgatttcgtcccgttcgacatcaccgaactgctggaccgcgccgcccacgacgccctgcgcgtctaccccgacgtggaggtgtcgctggtgccctcgccgacggtgctgatgatcgggctgcccaccgggctgcggctggtgatcgacaacgccatcgccaacgccgtcaagcacggcaacgccggcaagatccagctcaccgtcagcagctccggtgagggcgtggagatcgccatcgacgacgacggcagcgggattccggagtccgagcgcgccaccgtgttcgaacgtttcgcccgcgggtcgacggcggcgcgctcgggttccgggctgggcctggcgttggtggctcagcaggccgaattacacggcggcacagccgaattgcagaacagcccgctgggcggtacccggctgctgctgcggctcgccggagacgggcgcggaccggcgtagcgggccgatcgaagacagggcactcgacgtcaagccacgcgcccttgtgttagtagagcgatctatataatctgatgcccgggggcagcggatccgaaaggtacatcgatgaacgccagcgccgaacacatccggtatgagaagcggggccggatcgccaccatcaccctggaccggccggcctcgcgcaacgcgatcgatccggcgatggaccggcggctgcgcgacatctgggccgaattccgcgacgacgacggcgtcgacgtcgcgatcctgaccggggcgggtgaggcgttctgtgccggcgccgaccgcaacacctggtttcaccaatggctcgatgccgacgcggcggtggtgcgccgtaacgccaaaggcgttggcttcggcggcatcacccgcggactgcaccgcatcaccaagccggtgatcggggcggtcaacggctgggcgctgggcgccggcctggagctggcgctggcctgtgacatccggatcgcctccgagcgggcgatgttcggtgtgccgttggtgggcctgggttttcatcacggcgacggcggcatctcacggctggtggatacctgcgggctggccgtcgcgctggatctggaattgagcggcgaacccatcgacgcccaacgcgcgctgcaggtcaacctggtcacccgggtggtggcccacgacgacttgatgacggcggcccacgccctggccgagcgcattgccggttatcaccaggccgcggtgcgctcggccaaggacacggtgctcgacgtggtcgggcgaccgctggacgagcaactcgagcgggaggcgatgagcgcctactccatcgatcggcacagcgcccgcgagatcatcgccgcggtcgggatgcggggccactgatggccacggcgacccgcgaacggttcctgaccgcggccaccggactctttcggcgccaaggctattcgggcaccggcctcaaacagatcgtcgccgagagccgggccccgctgggctcgttgtatcacttcttccccggcggcaagcaagacctggccgtgcaggcgatcgcccacaccgccgagcgctaccgggaactgctcgaccgggtgttcgccaggtccaccgacatcgggcaggccaccgtcacgtggttcaactgggccgcccgcgccctgcaggaaaccgactacgccgacggctgcccgatcggcacggtggcctgcgaggtcgccagcagcaacgaggcgctgcggcaagccacccaggcggtgttcgcgtcctggcagtcccgggtggccgccgaactgatcggcgcgggtgtcccgaccgcgcaggcccgccggctggcgacgttcgcggtggccagcctggagggggcgatcctactcgcccgggcgcaccgcagcacccggccgctgcgcgacaccggccgcgtcgtcgccgacaccctgcgcgcggccaccgaccgcggctgaccgggcgactcgactcatgctcggccacctcggcatcaacgtgcccgacctgtccgtcgccaagcggtattacgacgcgctgatgccgctggtcggattcgagccgttctttgccgccgacgacgaattctcctatcgaccggccggcaacaagccgggcacctacctgttcttctaccccgcggccgaaccgcacgagtactcggcacaacgcaccggccttcaacacctggcattcatggtgcgaggacgctcggcggtgcacgaggtggacacccatgtaattcgaattggcggcaccgtcatttacccgccgcgccatttcccgcaatatcccggccactattacgccaccttttggtacgaccccttcggcatcaaactcgaggccgtctgccaccacgaccgggattagccgacggcgccgaccgcgcggcttccgggatttttgtgacagccgagtccggagtggtcgttgaggtttatcgccgactccttatgggaactcaggaatttcacgtttgggagccgtttggaaggcgtgtggaagccggttgagagcagagttgagcatcgaaattccgggccgggtgcccggcaggatccgtaccgaatacaagatcagcgaaagcgcactacactatggccccaagcacgtcggttggcgttgagcattcggagggaaaccatggttgtgtcggtgcagtcagagatggttctggcgtcggctggcgccgagtcggcgatcagcgccgagaccgaggcggccgcctcggcggcgtcgcccgcactgctgggcgtgatgccgatgggcggtgaccccgactcggccatgttcgcggcggcgctgaacgcctgcggggccagctacctgggggtcgtctcggagcacgccgcccagcgcggcctgttcgccggcgcgcaggggatggcgtccggggtgtacaccaccaccgaggcgatgcgctcgctggccatgggaatcagcagcgtcctctaaacctggtcaaagggggaagtacgcatggccgatcccggatgggctgcgcgtacgcccgaggacaacgacatgctgctcaaggcaggcgtcggggtgggcactcacgtggccaaccagaccgcctggacgaccttggccgccacccatcatgcctcgggcgtcgcatcggcgatcaacaccgccgcgacctcggcgagctggctgggcgccgggtcggcggcctcggcggccaacgtcaccatgctcaacgcgtcgctgcacggcctggccggctgggtcgacgtcaagccggcggtggtggccaccgccatctcggcctaccagatggcctacggctcgatgcgcccggcgcccgaatgcatcgccaaccggaccgagaccgcgaccgactacggcatcaacccgctggtcctcggcgcgctgacgccgcggatcgcgtcgctggaactcgagtactacggctccatgtggcccaacaactcggccgtcggcgccagctacggggcggtgctgaccgcgctggccgaaagcctggcgatcgcgccgccgatcgcgtccatgggcgcctcaccggccgcgccggccgaggcggtctcggcgatcggcgagtccgcggccaacgtcgccgccggcgacggcatgcgcgccgcctaccagggcgtgcagaccggcacccagggcgcggggcaggccgcctcgagcgggcaggacctgggcggccagatgagcagcctgatgcaaccggtgcaggagctgatgggagcggtgccgcaggcgatgcaggcccccatgcagatgatgcaggctccgatgcagatgatgcagccgctgcagtcgatgatgggcatgttcgccaaccccggcgccatgggcatgggtggggcggcgccgggagtctcggccgtctccgccaccaccgggctctccgccgcggaagccggtgccggtggcgccggatccctgggcagcgcgggcgtgcccgcaaccagtttcacccgtccggtcagcgccttcgagcccgccaccagtggccggccggtggggctgcggccggccggggcgttaggcgccgaggctctgcgaccgcagaccacgacgatgagtggagccccgatgggcggtatgcccgtcgggcacggggcgggaggccaacgcggatcccgtgacaaggccgaagagcccgcgaccgtgcgggtcgtcgacgaccgagtgtgagcagaccccctggtgaagggtgaatcgacaggtacacacagccgccatacacttcgcttcatgcccttacggggggcggccaacccagaaggagattctcaatgacgttgtcaagccgccgcggtagtggttgcggggtggtagacagcgtggtcgcgcagcatggcccacaggacgttgaggcggcggcgggccagggcgaggacggcttgggtgtggcgttttccttcggtgcgttttcggtcgtagtaggtgcgcgaggaggggtcggtgcggatgctgaccaaggccgacaggtagcaggcgcgcagcaggcgccggtcgtagcgtcgggggcgtttgaggtttccgctgatgcggccggaatctcgtggtaccggcgccaggccggcgacgccggcgaggcggtcggcggaggcgaatgcggccatgtccccgccggtggcggcgaggaactcagcgcccaggatgacgccgaatccgggcatgctcaggatgatttcggcgtggcggtggcggcgaaatcgctcctcgatcatcgcgtcggtgtcgccgatttcggtgtcgagggccatcacctccttggccaggcgggccaccacagtggccgccagttgttggccgggcacgatgctgtgttgggcgttagcggcctgcagcgcggtggctgcgacggtatcggcgttgcgggccttgcgtttacgcaagaacgcggctactcgagcgccaccggcgctgcgcagcgcgtcgggagtttggtagccagtaagcaggatcagcgcggcacggctcttgttgtagtcgaaggcgcgttccagcgccggaaagtattccagcagctgggcgcgcattcggttgatcgcccgggtccgatcagccaccagatcggaacgtcggctggtcaggatgcgcagctcgactgcgatgtcatcgccggcgcgcagaggctgcaagtcgtggcgcatccgggcctgatcggcgatgatcgcagcgtctttggcgtcggtcttgccttcgccgcggtaactacccgcggcgtgatggaccgtgcgcccgggaatataaagcagccgctgcccggcagcgatgagcaaggcgatcagcaacgcggcgccgccggcgttgaggtcgatcgcccacgtgacctcgcctccatcggccaacgtcgtcaccgccgcaatcaactccagcagcgcggcctcgtcgttggccacccgctgcgagagcaatcgctgcgcgtcgtcgttaataaccatgcagtaatggtcggccttaccggcgtccacgcccgcccagacaggttgtgccacaaccacctccgtaaccgtcattgtccagatcaacccagcagacgaccacgccgacgtgtccttacacagcgatccaatcgcatctctcaattagcggtcgagtcgtcgcgggacgccgggcggccaatctccttcggccatccaacacagcaaccacatgaaagccatacccgacgtccctgggcaattcgaagcctaaggccgacggccccgaacacccttcaagaaaggtaaggaattccgtgacaatcaaggtgaccccgcaaatgcttcgcgatacttccaacgcgattcaggcgaatatggaacatgccatcggcatcggtcagggttacgtcgcaaatcaggaaaatgtgatgaacccggccacctggtccggtgacgcggtggccgcgtcgcacgcgacggccatcgaggtgcaaaacgatttgaacaaggtgctcaccggtggcacccggctggccgagggcctcaccaaggcggccgccctgatggaaggccacgaggcggattcctcgcacgcattcagcgccctattcggcggccacggctcctgacccaccaaatccattcccataacaggcttttgaaaggaaattgatcatgtccgacccgatcacttacaacccgggcgcggtggccgacttcgccaccgacgtcgcctcccgcgccggccagttgcagtccattttcgacgacacctccaaccgcacgcacgccctgcaggaattcttcgccgggcacggcgcgtcgggctttttcgaggcgcaggcccagatgctgtccgggctgcaggggctcatcgacacgatccgccagcacgggcagaccacctcgcacgtgctggacagcgcgatcagcacggaccagcacatcgccggcctgttctgagccggcacgaccggaacgagggtggggcagatgcgccgagcgtgtgccccacctttcgtctttcttccccggctggggatcccgcgcggtgagggcagggcgacatgctgaccacgacggtcgacggcctctgggtgttgcaagcggtcaccgggatcgaacaaacctgccctgagctggggctgcggccgctgctgccgcggctggacacccccgagcgggcgctgcggcacccggcggccgccgagctggtggccgccggcgcgctcgacgaggccggcaacgtcgacccgatgattcgcgagtggctcaccgtgctgttgcgccgggacctgggcctgctggtgatgatcgccgtcccgggccgcgagccgagccgggcgtcgatctgccgcttcgccacctggtgggtggtgctggaacgccacgatcagctggtgcgcctctaccccgccggcacggccagcagcgaggccgccgccagcgagatcgtggtcggccagatcgagcggttgtgcggcgtggccgaggcggcgccgctgcggcccatcaccctggacaccgagcagctgctggcctcggtgcacgacaccgccagcctgcgggcgttcctgctcgagcagcgcctcgacgccgaccagctgcagacggtgctcaccgccgccgactcggcccgctcggcgcacgccaacatcgtcgcgctgcaggccggcgtcgggcccgacgagctggcccgcgtcgccgtcggcgattcgtcggtgtccatcgtggacacccccggcggccgggtctgcatcgaaagcgtggtatccgggcagcgccgctaccagatcctgtcgcccggctcgcgcagcgacatcggcggagcggtgcaacggctgatccgacggctgcccgccggcgacgagtggtactcgtatcggcgggtggtgtgacggtgcggccccgttatcgcgtcaaactaacttggtcaaccaaagtcttggaatagcaacgcctgtcgtacttgaaaggtttgtgatcgggtaaacgtggtatcgcaaaccgtgttagcatcgcgtcgtgacgagcccttggaatgacccgaatatgtcggacgaaggagcgctcagacggggggatccgtcagggggcagcaacttcccggattcggtatcggacacgatgcgtattaccgatctggccgcgccgcgaaaaattccaccggggtccggctggcggaaattcatttacaccatctcatttcacaaaataaatcccggtgaatctccccgcgaacggcactaccgcgacctgcaaaatcgcatccggcgccatattcgacggcagtacgtcatcaccgtcgtctccggcaagggcggcgtgggggtcaccacgctggtcgcctgcatcggcggtgtgttccgggaatgccgcccgcagaacgtgattgccatcgacgcggtcccgggtttcggcacgctggccgaccgcatcgacgagtccccgccgggcgactacaccgccatcatcaacgataccgacgtccagggctacgccgatattcgagaacacttggggcagaacgcagttgggctggacgtgctggccgggaaccggacctcggaccagccgcggccgttggtgcccgcgatgttctccggggtgctgtcgcggctgcggcgcactcacaccgtgatgatcgtcgacacctcgcccgacctcgaacacgaagtgatgaagccggtcctggagaacaccgataccctggtattcgtctccggcatcaccgcggaccgctcgcgtccggtgctgcgggcggtggattacctgcgctcgcagggctaccacgagctggtctcgcgcagcaccgtgatcgtcaaccacaccgaccagatcaccgacaaggacgcgctggcgtacttgaccgagcggttcaccaaggtcggcgcgacggtcgaggcgctgccgttcgacccgcacctggccaagggcggcatcatcgacaccgtccacgagctgaagaaaaagacgcggctgcggcttttcgagatcaccgccggactggccgacaaatacattcctgatgccgagcgggcggtgccgtgacatcgccgcataaggtcgcctttccggcgcgttgtgcggtcaacatttcttacgagaagcacctgtgttcccaagtctttccggccggaattccggtggagggattcttcgagggaatggtcgagctcttcgacgccgacctgaagcgcaaaggtttcgacggcattgctttgccggccggcagctacgaactgcacaagatcaatggggttcggctcgatatcaataagagcctggacgagctgggcgtccaggacggcgacaccctggtgctggtgccgcgggtggacggcgagtcgttcgaaccgcagtacgagtcgctgtccagcgggttggccgccatgggcaagtggctgggccgcgagggcggtgaccggatgttcgctccggtgacgccgctgaccgccgcgcacaccgcggtcgcggtgatcgcgatggcggtggcggtggtggtggggctgtgcctgcgggcgcggaccttcaccgacggcccgatccccgcggcggtggccggcggcatcggtgcgctgctgctgatcgcgacgttggtggtgcgcagcgggtggcgcgagcgccgcgacctgttcagcgggttcgcctggctggcggtggtggcgctggccgtagccggcgcctgcgccccgcccggcgtgctgggcgccgcgcacgcgctgatcggggtcgtggtggtgatcctgggggccatcgcgatcggggtgacggcacgcaaccggtggcagaccgcggtggtcaccgcggtggtgacggtgtgcggggtgctggccgcggtcgccgcggtccggatgttccgtcccgcctcggtgcaggtgctggcgatctgtgtgctggtgggattgcttgtgctggttcggatgacgccgctgatcgcgctgtgggtggcccgggtccggccgccgcacttcggctcgatcaccggccgcgacctgttcgcccggcgcgagggcatgccggtcgacaccgtggccccggtcagcgaggacgaatccgaggagcaggacaacgaattgaccgacatcaccgcgcgcggcgccgcgatcgccgcctcggcgcggttggtcaacgcggtccaggtggggctgtgcgtcggggtgtcgatcgtgctgcccgccgcggtgtggggcgttttgacgcccggacggccgtgggcgtggctggcgctggtggtcgccgggctggtggtgggcatcttcatcacccagggccgcggcttcgccgccaagtaccaggccgtcgccctggtgtgcggggcgtcggccgcggtgtgcacgggagtggtcaaattcgcgctcgccgcgccgcacgatgcgatgaccgggctgctgtggccggtggtggcggtggccaccttcgccgcattcggtttggccgcagcgcttttggtgccgacgatgcggttccggccgttcatccggttgaccgtggaatgggtggaagtgctcgcgttcatcgtcctgctgccggcggcggcggccctgggagggctcttcacgtggattcgccactgagacgggcggcggcgctggtcgccgccctgaccctggtcgcattatcagccaatgttactgtcgcacaagcgattacacccccctcggtggatccgggcatggtgccaccggacgggccgccgcggcccgaccagccgatgcggcgcgccaacagctgttcggcgccgatcaccgtgcgaaacccggacgtggcgcagctggcgcccgggttcaacctgctcaacatcgccaaggcctggcagtacagcaccggcaacggggtgcccgtcgcggtgatcgacaccggggtgtcgccgaacccgcggctgccggtggtgcccggcggcgactacatcatgggcgaggacggcctgtcggactgcgacgcccacggcaccatcgtcagttccatcatcggcgctgcgccgcaagggatcctgccgatgccgcggccgatgccggccaccccggcgttcccgccgccggccgggccgccgccggccgtgggcgcgccacccccgccggtcgaggtgccgcccccggtggcgcccccgcccccgccgccgccggtgaccatcacccaggttcttccgccgcccccgccaccgccgcccccgccgccggagggcggcggcgccaccgccgcatccaacgggccgcccgatccgcagaccgaggacgaacccgcggtgccgccgcttccgccgggcgcgcccgacggggtggtgggcgtggccccgcacgcgaccatcatctcgatacggcaatcctcgcgggccttcgaaccggtcaacccgccgccgggcgaccccaactccgacgagaaggtcaaggccggcacgctgaattcggtggcgcgcgcagtggtgcacgcggcgaacatgggcgccaaggtgatcaacatctcggtcaccgcgtgcctgcccgcggccgctcccgccgatcaacgcgcgctgggcgcggcgctgtggtacgcggccaccgtcaaggacgcggtggtcgtggccgccgccggcaacgacggcgaagccggctgcaacaacaacccgatgttcgacctgctggacccgtccgacccgcgggactggcatcaggtcaaggtggtctcggcgccgtcctggttctccgactacgtgctgtcggtgggcgccgtcgacgccagcggcgccgcgctggacaagagcatgtccggcccgtgggtcggggtggccgcgcccggcacccacatcatggggctctcgccgcagggcggcgggccggtcaacgcctacccgccgtcgcggccgggcgagaagaacatgccgttctggggaacgagtttctcggcggcctacgtcagcggcgtcgcggcgttggtgcgcgcgaagttccccgagctgtccgcgcatcaggtgatcaaccggatcgtgcagtccgcgcacaatccgccggccggggtcgacaacaaggtcggctacgggctggtggacccggtcgccgcgctgaccttcaacatcccaccgggtgaccggatggcgccgggctcccaaagccggatcatcactccggccccgccgcccccgccgcccgatcaccgggcccgcaacatcgccatcggattcctggggaccgtcgcggccggggtgctggtgctcgcgatcgcggcgcgattgcggagggcccgatgagacccaacctcaccgggttcagccgcggcagcaaccgccgggtggtcggggtgtgggtggtgttcgtgctcgcgctggcgagctggctgctgggcggctacatcgccgccgcggtggccgtgctggtgggcgtcgcgctggtgttcgtgcgctggtggggtcagccggcctggtcgtgggcggtgttgtggcggcgcggccggcgtcccatcgactggtcggccccgatcacggtggccaacaaccgatccggcggcggtgtgcgggtgcaggacggcgtcgcggtggtcgcggtccaactgctgggccgggcgcaccgggccacgctggtgaccggctcggtgaccgtcgagaccgaaaacgtgctcgacgtcgtcgaattggcgccgatgctgcaccaggcgctgggtttgcagctcgattcgatcagcgtcgtcaccgtcgggtcccggcacggcaacgtgggcgattacccgcgggtctacgactcggagatcggcaccccccccgtacgccggccggcgcgagacctggctgatcatgcggttggcggtgatcgacaacgcgcaggccctgcgctggcgcacaaccgttggcgcggcggcgatttcggttgcccagcggatcgccgggctgctgcgctgccaggggctgcgggcgaaggtggccaacgccaccgacctggccgagctggaccgacggctcggctgggatgcggtgtccggcaccgtgcagcgctggaaggccatccgcggggaagccggctggatgaccacctacgcctatccgccgcaggcgatcacctcacgcaacctgtcccaggcgtggacgctgcgcgccgacgaggtgatccagaacgtgaccgtctatcccgacgggcactgcagcgcgacgatcacggtgcgcaccccgacccccgcccccacgccgcccagcgtgatcctgcgccggctcaacggcgaacaggccgccgcggcggccgccaacatgtgcggcccccgaccacacctgggcgggctgcggcgcagccggctgcccgccgagctgatcaccgagatcggcccgtcgggcgtgctgatcggcaagctgcccaacggcgatcggctgctgatgccggtcaccgacgccggcgaactgtcgcgcgtcttcgtcgccgccgacgacccgatcgccaaacgcatcgtgatccgcacggccggcgccggcgaacgggtctgcgtgcacacccgcgacatgtcgcgctgggtcagcgtgcggatgccggagatcagcgtcgtcaacagctcccgcccggccccgcggaccaccgtcagcgtggtggagtacgccccgcgccgtggcgagggcgtcgaggccgcgatctcgcccaccccgcggccggcgaccgtgatcaccgtcgcccccgccggcaccaccctgtccgaggcgcagcggcacggcttcgaggtgatcatcgaacaagtcagccccgcggtggtgaacgtcagtgcggcggggaagaattggcttgtcgagatggacatgttccgcgccgagcaccgctacgtcagcctggagccggtcagcatgtccgtcggcatgtagcgacgccggtgctctgatgggggaatgtgatgggtgatttgcaaactgcccgaaggcatttcgaccgcgccatggcgatcatgagccgccaggggcgggcggccgcgttgccggagttcgtcgccgccaccgacgccgacccgtcgatggccgatgcgtggctggggcgcatcgcgtgcggcgacagcgagctggcgtcgctgcgcaagctctacgccaccagcgaatggctgcaccgcgagaccacccggatcgggcagaccctggccgccgagatccagctgggcccctacatcggcatcaccgtcaccgacgcctcgcaggtcgggctggcgctgtcgtccgcgctgaccatcgccggggagtacgccgaggccgacaagctgctggccaaccgcgacctgctggactcgtggaccaactaccagtggcaccagctggcccgcaccttcttgatgtaccggacgcagcgctggccggatgtgttgttgacggccgcggaggagttgccgccgcaggccatcatcatgtcggcggtgacggcctcgatctgcgcgctggccgcgcacgccgccgcccacctgggccaggggcgggtggcgctggactggctggaccgggtcgacgtcatcgggcagacccaggcgtcgtcgcgcttcgacgccgatgtgctgaccgcgtccatcggcccggccgacatcccgctgctggtcgccgatctggcctacgtgcgcgggatggtgcaccgccagctgggcgaggaggacaaggcccagatctggctgtccaaggccaccatcaacggcgtcctcaccgagcccgccaaggaggcactggccgacccgaacctgcacctggtgatcaccgacgaacaaaccatcgacagccgcaccgaccggtgggacgcctcgtcggccaagagccgcgacgagctcgatgacgacgccgccgccgaacggcgcgccgagctgctggccgagggccgccggctgctggccaaacaggtggggctggccgcggtcaaacaggcggtcgccgcgctggaggaccaactcgaagtgcggatgatgcgcctcgagcacggcctgccggtggagggccagaccaaccacatgctgctggtcggcccgccgggcaccggtaagacgaccaccgccgaggcgctgggcaagatctacgccggcatgggaatcgtgcgccaccccgagatccgcgaggtgcgccgatcggacttctgcgggcacttcatcggcgagtcgggccccaagaccaacgagttgatcgaaaagtccttgggccgaatcattttcatggaagagttctactcgctgatcgagcgccatcaggacggtacgcccgacatgatcggcatggaggcggtcaaccagctgctggtcgccctggaggcgcaccgcttcgacttctgcttcatcggcgccggctacgaagaccaggtggaccaattcctcaccgtcaacccgggtttggcgggccggttcaaccgcaagctgcggttcgagtcctactcgccggccgagatcgtcgagatcgcgcaccgctacgccaccccgcgcgccagcctgctcgacgaggccgcgcgcgagacgctgctggacgcggcgaccaccatccgcaactacaccactcccggcggccggcacggcatcgacgcgatgcagaacggccggttcgcccgcagcgtcgtcgaacgcgccgagggcttccgcgacacccgggtggtcgcgcagaagcgtgccggccaaccggtcacggtggatgacctcaagatcatcaccgccgccgacatcgaggcggcggtgcgcagcgtgtgttcggacaaccgcgacatggccgccatcgtctggtgagcggcgcccgccgtcacgccgggtcgaagcggaagacggcgagttgccctgccagcgcctcgaattcgtcggccgtgccgtcgcgcaccagccccgaccgtttcgcgaaccccaccccgaccgggaccttggcggggaactcgcgcagcaccggccgggcttcgtcggcggacagttcgacgatgcggacgcgccgggaccgccggccccggcgcagcgtgccggtgcccgcggcgcgggcgttggccgcccagtcggcgccgggatagccggccaccacgtacaggccgccccggaactcgaacggcgtcatcggcgtgctgcgcggctgacccgacttgcgcccgggcacggtgagcaccatggccggcccggtcgggatgcccagccgctgcacggccatcatcaccttgttcatcggtctgaggtaacgcgggggacgtagtgcggtcatgtcagactccttccttgcgttcattgcggcggtcgaacaggtcgcggtgcgtggcgacccagtgggcgaacggaagtgccgggcgcccaaggattttctcgacgtcgtgggtgaccagggcgggtttgtccagggtttcggcgagcatggcgaggtaggcgtcggcgaaaccggcgcccaggcccaacccgacgaaccgctgccgcaccgctgcggcggggatctcctggtaccgcagcgaccggcccagcacggtcccgatcacctcgaccaactgggcgttgctcaacgcctgcggcccggtcagcgggatccgttgtccgacaaggtcatcggtgagcagggcgtgcgctgcgacgtcggcgatgtcggtctcgacgatcggcgccgaggacgccgccgcatacggcccggcgaccacgtcgccttcgcgcagctgcgccgaccacatgccggcgaagttcgtcgcgaacacggtgggccgcaggctcacccacgccagaccggagccgacggcgagctgttctacctgcctgttgcggtcgccgcgaaatcgggacggttggcgggagaagtcgtcgtcggcgttgatcgccgacagcgcaaccagcttcgtgaccccgccgcgcgcgcaccgggccacgacgtcctcgagctgcccgcccagcgcccgggcgttcaggaagaccgcggaggcgcccggtagcgcgtcggcggcggtatcgaagagctcgacctgtgccgggaatccggctggtccggatcggcgggtgaccgcccggaccggtgcgccggcggcgagcagcgcggtgaccagcgggcgccccacgttgccggtggccccggtgacgacgattgtcatgtgcgtgttccttccaggtgtttcgtccactgctgcaaggacggggccgaaggtgggaaagttacaccgggagaacgggtaactttttgcggcagcagatcgtcgaagagtcatgaaccggtcgccgtcagccgacgaccaggtcgccgaggcctggcgtcgtcaccgcccctacctggtcaacctcgcctaccagatgctgggcgacatcggcgacgccgaagacgttgcgcaggaggcattcctgcggctgtccgccgcgggcgacatcgacgacgtgcggggctggctgaccgtggtggccagccggctctgcctggaccagctgcgctcggcccgcgcgcgacacgaacgtccgggcgatgtcggcgagcagccggccccgccgcggttcgacccggccgaccggatcaccctcgacgacgaggtccgcaccgcgctgctggaggtgctgcgcaggctcagcccgggggagcgggtcagcttcgtgctgcacgacgtgttcggggtgcccttcgaggccatcgcgcagaccgtgggccgcccggttggcacctgccgccagctggcccggcgcgcccgggcgaaattcgttgccgcgcaaccgaagctgaacaccgtgggcgcggccgagcatcagctggtcaccgagaagttcatcaccgcatgcgccaatggggacctggccgggttggccgccgtgctggatccgacggtctggggtgtgggcaccgtcctcgccgacccggccccgccgccgcaggtcaaccacggcccggatgcggtggccaccaacctgcttcgctacctgtggccggacgtcaccctggtcggcgggccggccggggcgccggtgctgctggcgttcagccgacgccggctgttcgccgtcatcgtgctcagcatccgcgacgcgcgggtggtcaagatcgaggcgatcgccgacccggcggcccgcagcgccggctagtgttccggcgggcgccggtcggcggaacggtcggggcggcgggcgaagtagccggcgatcgtcgccgtcacctcgaggaacttgcgccgggtggccggggccatctcagcgttcacgtcgatcacgccgccggggcgcagatggggatcgaacggcacctcgatcaccgggcggccgtggtcgatgaactcgcgggcgagcagcgcccgggtgcgcttgtcggcgtggccgtccgaatcgttgagcaccacgaggctgtgggccagcagcgtcgtcaggccgtgatcggccagccactccagggttctcgcggcggccgacgcgccgtcggcccacggtgaggacaccacgatcagcgcgtcgaggtcgcgcagcacctcctgggtgagcggcgcgtccatggtcgagccgcagtcgatcaccgagatggtgaagtgccggtccagccgccgcgtggcctcccggtagatcgccggatcgagcacccggcggggacccgacgccggctcgccgccgagcacgtgcaggcccgcggcgttgcggcccagccgggccaccacgtcgtcgaacgaccgcaggttctggtcggcggtgagctcccagaacgagcccgtcgacgccggatcgatgcggctgcccagccgcccgaacgcggtgtcggcgtcgatcgccacgacgtggtcctgccggcgcagctcggcgaacagcgagccgacgctggcggccaccgacgtctttcccaccccgcccttgccgagcacgccgaccttgtagttgccgtacaggcgggcctggatggcctgctcgaattgcgcctcgcggcgttgggcgggggatgggcccaggtcgatcaggccgaatgtggcgagccgcagggcgcgtcgccaaccgcggtcgggcagttgcggcgtggcggaaggctgcggccgcggggtggggggcgccgcgggagccggggccgcggcgggcgggtgcgggcgaaacgtgggcggtgccggcggccgggtcgggggcgttggggccggcgtcgggggccgcggcggcggcgcggggcgcggggcgaccgggggcggcggcgcctcgggcgcgggccgggcgctcggccgctcgggctgcagacggtcccgcaggaattcgtcgcgctcgttcatgggctcctcggatgccaggccgtcgatcgtcgcggcggtggcccggccgcggcgggctcgtcacgtgatgagcgccacggtccaccgtgcgacgccggatgtgaccgatacccgtccagtatcgcctcactggcccgcgcgccctaccgggtcggcacctgcaaaccccgccgggacaccgcccgggccgatacccgcgtgccaaagccgccgccggcgcccacacgccgctcaccagcaaactcgcgtcggcgggggccgcccgccgcgcctcacccgggatcggcgctgttgcgccgagaattcccggcctcggttggcggcccggccgccgcggcggcgggtggcggcagcgaaatttttcggcgccgcccaccggcggttagacttgtcgaagttggcatgtcaggcgggtattgtcatatcgttttacgacttgtcgagaccggttccaggccaccgttcaaagctgcacggacgtccccaacaggatcatctccgcctggcgcacagcccatcgagacaaggccgacggggttctaccgcaacctccggtgtgacctcgtcggggccgctgccaacggccgcgcagaacgttcaggtgaagggtcaggtgcatatgacgcccaagcgcgccgggttgtacaaccccgcgttcgagcacgacgcgtgcggggtagccatggtcgtcgacatgcacggccgacgcagccgcgacatcgtcgacaaggcgatcaccgcgttgctcaacctcgaacaccggggtgcccaaggtgccgagccacgcagcggtgacggcgccggcatcctgatccaggttcccgacgccttcctgcgcgaggtggtggacttcgagctgccgcccgagggcagctacgccaccggcatcgcgtttttgccgcagtcgtccaaggacgccgcgaccgcttgtgccgcagtggaaaagatcgccgaggccgagggcctgacggtgttgggctggcgcaacgtccccaccgacgactcgtcgctgggcgcgctgtcgcgcgacgccatgcccaccttccggcaggtgttcatggccggcgcctcggggatgacgctggagcgccgcgcctacctgatgcgcaagcgcgccgagcacgagctcggcaccaagggcccgggtcaggacggtcccggacgcgaaaccgtttacttcccaagcctttccggtcagaccttcgtgtacaagggcatgctgaccaccccgcagctcaaggcgttctacctcgacctgcaagacgaccggttgaccagcgcgctgggcatcgtgcactcccgcttctccaccaacacttttccgtcgtggccgctggcgcacccgttccggcgcatcgcgcacaacggtgagatcaacaccgtcaccggcaacgagaactggatgcgggcgcgcgaggcgctgatcaagaccgacgtgttcggcaccgaggccgacgtcgagaagctgttcccgatctgcaccccgggcgcctcggacaccgcgcgtttcgacgaggtgctcgagctgctccacctcggtgggcgcagcctggcccacgcggtgttgatgatgatccccgaggcctgggaacggcacgagtcgatggaccccgcccggcgggcgttctaccagtaccacgcctcgttgatggagccctgggacggcccggcgtcgatgaccttcaccgacggcaccgttatcggcgcggtgctcgaccgaaacggcttgcgcccctcgcggatctgggtcaccgaggacggcttggtggtgatggcgtcggaggccggtgtgttggatctggacccggccacggtggtgcgccggatgcggttgcagcccggccggatgttcctggtggacaccgcccagggccggatcgtctccgatgaggagatcaaggcggagctggccgccgagcacccctaccaggagtggctggaccgcaacctggtcccgctcgacgacctgccgcagggcgactacaagcggatgccgcacgaccgactggtcaagcggcagcagacctttggctacacctacgaggaactgaacctgttggtggcgccgatggtgcgtaccggcgccgagccgatcgggtcgatgggcaccgacaccccggtcgcggtgctctcgcagcggccgcggatgctctacgactacttccagcaactcttcgcgcaggtgaccaacccgccgctggacgccatccgcgaggaggtggtgaccagcctgcagggcaccaccggcggcgagcgcgacctgctcaccccgaccgagctgtcgtgtcaccagatcgtgttgtcccagccgatcctgcgtaaccgcgagctggcgaagctggtcaacctgaaccccgacgacgaggtcaacgggcgcccacatggcatgcgttccaaggtaattcgctgcctgtacccggtggccgagggcggcgccgggctggccgccgccctggaggacgtgcgcgcgcaggcctcggcggcgatcgccgacggcgcgcgggtgatcatcctttccgaccgcgaatccgacgagaagatggcgcccatcccgtcgctgctggcggtggccggggtgcaccaccacctggtgcgcgaccggacccgcacgcacgtcggcctggtggtggaaagcggcgacgcccgcgaggtgcaccacatggccgccctggtcggcttcggcgccgcggcgatcaacccctacatggtgttcgagtcgatcgaagacatgctcgaccgcggcgtcatcgagggcatcgaccgcaacaccgcgctgaacaactacgtcaaggccgccggcaagggtgtgctgaaagtgatgtccaagatgggcatttcgacgctggcctcctacaccggcgcgcagttgttccaggcggtcggcatttccgaggacgtactcgacgagtacttcaccgggttgagctgccccatcggcggcatcaccctggacgacatcgccgccgacgtcgccgcccggcacgcgctggcctacctggaccgccccaacgaacgcgcgcaccgcgagctcgaggtgggcggggaataccagtggcgccgcgagggcgagtaccacctgttcaacccggagacggtgttcaagctgcagcacgccacccgcaccggccagtacaagatcttcaaggactacacccggctggtcgacgaccagagcgagcggatggcgtcgctgcgcggcctgctcaagttccgcgccggggtgcgcccgccggtcccgctggaggaggtcgagccggcgagcgagatcgtcaagcgcttctcgaccggggcgatgagctacggctcgatctccgccgaggcgcacgagacgctggccatcgccatgaaccggctgggcgggcggtccaacagcggcgagggcggcgaggacgtcaagcgcttcgaccgcgaccccgacggcagctggcggcgcagcgccatcaagcaggtcgcctcgggccggttcggtgtcacctcgcactacctgacgaactgcaccgacattcagatcaaaatggcccagggtgcgaaacccggtgagggcggccaacttccggggcacaaggtgtacccgtgggtggccgaggtgcggcactccacccccggtgtcggtctgatctcgccgccgccgcaccacgacatctactccatcgaggacctggcccagctgatccacgacctgaagaacgccaacccggccgcgcgggtgcacgtcaagctggtctcggagaacggcgtcggcacggtggccgcgggcgtgtccaaggcgcacgccgacgtggtgctgatctccggtcacgacggcggcaccggcgccaccccgctcacctcgatgaagcacgccggcgcgccttgggagctggggctggccgagacgcagcagacgttgctgctgaacggtttacgcgaccggatcgtcgtccaggtcgacggccagctcaagaccggacgcgacgtgatgatcgcggcgctgctgggcgccgaggaattcggcttcgccaccgcgccgctggtggtgtccggctgcatcatgatgcgggtctgccacctggacacctgccccgtcggcgtggccacccagaacccggtgctgcgggaacggttcaccggcaagcccgagttcgtggagaacttcttcatgttcatcgccgaagaagtccgggaatacatggcgcagttgggattccgcaccctcaacgaggccgtcggccaggtgaagtcgctggacaccacgctggcgcgggcgcattggaaggcgcaccggctggacctgggcccggtgctgcacgagccggaatcggcgttcatgaaccaggacctgtactgcagctcacgccaggaccacggcctggacaaggcgctcgaccagcagttgatcgtgatgagccgcgaggcgctggactccggcaagccggtgcggttctccaccacgatcagcaacgtcaaccgcacggtgggcaccatgctcggccacgaggtgaccaaagcctatggcggccaagggttgccggacggcaccatcgacatcaccttcgacgggtcggcgggcaacagcttcggcgcgttcgtgccgcgcggcatcaccctgcgggtctacggcgacgccaacgactacgtgggcaagggcctgtccggtggccggatcgtggtccggccgtcggacaacgcgccggccgactacgtcgccgaggacaacatcatcggcggcaacgtgatcctgttcggcgctaccagcggggaggcgtacctgcgcggtgtcgtcggcgagcggttcgcggtccgcaactccggggcgcacgccgtcgtcgagggcgtcggcgaccacggctgcgaatacatgacgggcggcaaggtcgtcgtgctcggccgcaccggccgcaacttcgcggccggaatgtccggcggtgtggcctacatctacgacccgcccggcgaattcccgcaacatctcaacgcggagatggtcgagctcgagagcttggacgacgatgacatcgagtggctgcacggcatgattcaggcacacgtcgacgccacggattccgctgtgggccagcggattctgggcgactgggcgcaacagcagcggcacttggtcaaggtgatgccgcgcgactacaagcgggtgctgcaggccatcgccgaagccgaacgtgacggcggcgatgtcgacaaggcgatcatggcggccgcgcatggctgatccgagcggcttcctgaaatacacgcatcgggaactgccgaagcgccggcctgtcccgctgcggttgcgcgactggcgcgaggtctacgaggaattcgaccacgggaccctgcgcgagcaggccactcgatgcatggactgcggtattccgttctgccacaacggttgtccgctgggcaacctgatcccggagtggaatgacctggtgcgcaccgggcggtggcgcgacgccatcgagcggctgcacgccaccaacaacttcccggacttcaccgggcggctgtgcccagctccgtgcgagccggcctgcgtgctcggcatcaaccaggacccggtgacgatcaagcagatcgagctggagatcatcgacaacgccttcgacgagggctgggtgcagccgctgccgccagacaagctgaccggcaagaaggtcgccgtggtcggctccggcccggcgggtctggccgccgcccagcagctgacccgggccgggcacagcgtcaccgtcttcgagcggtccgacaagatcggcgggctgctgcgctacggcatcccggaattcaagatggaaaagcgggtcctggaccgccggctggaccagatgcgcgccgagggaaccgaattccgcgccggcgtcaacgtcggtgtcgacatcaccgcggaccagctgcgcgccgacttcgacgccgtcgtgctggccggcggcgccaccgcctggcgggatctgcccattcccggccgggagctggacggcatccaccaggcgatggagttcttgccgtggggtaaccggcaagcctcgggcgacctggacgaggccgacatggacgccgacgggcagccgccgatcaccgccaagggcaagaaggtcatcatcatcggcggcggcgacaccggcgccgactgcctgggcaccgtgcaccggcagggcgccaccgaggtgcaccagttcgagatcatgccgcgtccgccggacacccgcgccccgtccaccccgtggccgacctacccgctgatgtaccgggtgtcctcggcgcacgaggagggcggcgagcgggtgttctcggtcaacaccgaggagttcgtcggcgagaacggtcgcgtcacggcgctcaaggcgcacgaggtgaccatggaggacggcaagttcgtcaaggtcgagggctcggagttcgaactcgaggccgacctggtgctgctggcgatgggattcgtcggccccgagaaggagggcctgctcaccgacctcggggtgaagttcaccgagcgcggcaacgtcgcgcgcggcgccgatttcgacacctcgattccgggcgtgttcgtggccggggacatgggtcgcggccagtcgttgatcgtctgggcgatagctgagggccgggcggccgcggcggcggcggatcggttcctgatgggcgccaccgcgctgccggcgccggtcaaacccaccgcggtaccgctgcagtagtaacaccagtcacaccagaaacacgaccggtttcgctcggcgcgtcttccacagtttgccaggacgttggtgtctaataacccgttgtgagcccgctcacaggggggtcacaccggtttcccggttgaaggaccgaccgcaggagtgttcgttgtgcatatcaatccagtacctcggtcgcggatggggcgaatcgcctggtcatggctgcgtcatccggtgaagagccgcgagttccccgccaagcacgagcgtctggtcaccgcgcaggaccttctgctgttcggtgtgtgatcgccgggccgacgtggcgcccgacccccggtgtgtttgctcgcggcgggcccggcgggcgggtgcctcaggaacgcaataaacccgagtcgcggatcgcctcggcgagcggctccagcaccgcggggtcgtgcggcggcggcaggtagacgatgccgagatccaatccctcggcggccagcgcggccgcgtcgtcgatgaccttgccgtagtcgaggtccggctccagccgcaggtgcgccgagagcaggatctccttgggatcgcgcccgatgtccgcgcagtgcgaggccagcacgtcgcgcttgtgggcgaagacgtccggcgggccgccgacgaagttccagtgctgggcgtagcgggcggtgatccgcagggtgcgcttctctccgctgccgccgatgcagatcggcgggtgcggccgctgcggtcccttcggctcgttgcgggcccccttgagctggtagaacttgccgtcgaagtcggtggtctcctggctgagcaggctggtcagcaccgcgcacgcctcctcgaagcggtcgaagcgttcccggatgctgcccagttcgatgccgtaggcgccggactcctcctcgttccagccggcgccgataccgagctcgagccggccgctggagatgatgtcgaccgcggcggccatgttggccagcaccgcggggtggcggtagtggatcccggtgaccagagtgcccagccgcagccgcttggtggcctgcgccagcgcggtcagcgtcgtccagccctccaggcaggggccgctgctgtcggagaagatcgggtagaagtggtcgaacgtccagccagattcgtagacgtcgatgtcgtcggccgcttgccagacggccagcatctgggcccaggtggtgttctgcggggaggtcttgaaggcgaatcgcatgacgccgacgttagtcggtctttatgaaggacaactaaactcgacgttctgatgacgttcggttgtggctccctgggactcgacaccaagatcaccctgctggccgcggggctgatctttttgctcgcgctgatcctgggcgtgtggaagtaccgcgagatgatgacctcgcagaaccaccttgcgcatccctacgtcgacatcgcgcaccgggcggcgctgctgtactcgttcgccacgctgctgatcgcggtgttcgtgcaactgagcgcctggccggtgtgggtgaacctggccgcggccggggtgctggtcttcttcttcctggcggccatcctggcctacatcggccacggcgcgcggcgcgacaccgtcaaccagttcgagcgccccaccgccggactgcggtggtcgatggccgcgctgatcgtcggggagatcggcgggttcggcgtgctgttcgccgggttcgtcgccggacagctgtggtgatccgcgcgggggttcggcggtgatctccggcgcccggcctctccgcgctggcggtcaccgcgcgggcacactggagtcatggacccggtagttgcgctgcggcagatcgcgtactacaaggaccgcagccgccacgaccccaggcgggtgatggcctaccgcaacgcggccgatgtcatcgagggcctcgacgaggcgacgcgggagcgccacgggcaggccaacagctggcagtcgctgcccggcatcggacccaagaccgccaaggtgatcgcgcaggcctggtccggtcgcgaacccgacatgctggtcgaattgcgttctgctgcagaggatctcggtggcggcgatatccgttcggcgctgcgcggcgatctgcatgtgcactcgaactggtcggacggttcggcgccgatcgaggagatgatggccgccgcggcggcgctcggtcacgaatactgcgcgctgaccgaccattcgccgcggctgaccatcgccaacggcctgtcgccggagcggctgcgcaagcagctcgacgtgatcgaccggctgcaggacaccgtcgcgccgatgcgcatcctgaccgggatcgaggtggacatcctcgaggacggcgggctggaccaggaacccgaactgctggagcggctcgacgtcgtggtggccagcgtgcactccgagctgtcgatggattccgccgcgatgacccgccggatgctgcgcgccgtgcaaaatccgcacgccgacgtgctcggccactgcaccggccggttggtgtccggcaaccgcggcatccggccggagtccaagttcgacgccgaggcggtgttcaccgcctgccgcgagcacggcaccgcggtggagatcaactcccgcccggaacgccgcgacccgccgacccggctgctgaacctggcgctggagatgggctgcgtgttcagcatcgacaccgatgcgcacgcgccgggccagctggaattcctcggctacggcgcccagcgcgccctggacgccggggtgcccgtcgaccggatcgtcaacacctggccggccgaacggctgctggagtggacggccggctaggtccgatcagtccggcaggtgcggcatctcgagtcccgggtcgcggcccagcaacaccgccggcgtcagcgccgccttgccgtagcggcgccgcacccggtcgatcgcggcgtcgatggcatctggcggccgaccctggaacggcagcatcaactgctgggcgccgtcgcggtcgatgcccgacacggcgaagccgaccagcgtcagaccgcgccgcgcgatcatcggcgccgcgcccgccaccagccgccgggcggcggccaggatcggcgcggtggacgacgtggcccacggcagggtgtgcgagcgggtcgcccgggtgaagtcgtcgaagcgcagccgcagcaccaccgtgcgaccggtgcgcccggcggcgcgcatgcggccggtgacgcggtcgatcaggttgaccaccacggcgtcgatctcgctgtccgacatggtgtttccggcccggcccagcgcccgctgggcgccgaccgaccggcgccgcacaccggtgctcacccgcctgcggtcgatgttgcgggacagcgcgtagagctgccggcccattgcggcgcccaccatcgagcccagcgtcgactcgctgagctccgccacatcggccacggtggcgatgccgtgcgcgcgcagcttctcggccgtcaccgcccctacgccccacagccggcgcaccggcagcgggcgcaggaaggccagctcctgatcgggcggcaccagcaacagcccgtccggcttggcctgctggctggccaccttggccaggaacttggtccgggcgatcccgacggtgatcggcagcccgacccggtcgcgcacgtcggcgcgcagccgctgcgcgatggccaccggcgtgccggacacccggcgcagcccgcccacatcgaggaacgcctcgtcgaccgacagcggctccaccagcggggtgcactcgcggaagacccggaaaacggcgtcgctggcccggctgtaggcgtgcatccgcggcggcaccaccacggcgtgcgggcagagccggcgggcctgcgccccgcccatcgcggtgcgcacgccgtaagccttggcctcgtagctggccgccagcaccacgccgccgccgacgatcaccgggcggccgcgcagcgtcgggtcgtcgcgctgttccaccgacgcgtagaaggagtccaggtcggcgtgcaggatggacgcatcacaccgcacgaacatatgttcgcatgcggtgccgacaggcggcgctagccggattcgccgtagatgctgctgacccagatgtgggtgagggtgtcgaccacccggtcctcggcgacggccggggtctcggcggacagggcggccatcatggtgcgctcgttcatctggttcaacgacgtggccaggtcggcggcgggaatggtgtccggcgccgcgccgcgctcgcgttcggcggtgatcatggccgcggtctggtcgatccacttctgcatgaatcccgaccacaccgcgcgcagctcggagctggtggccagcgcctcggtggccgcgcgggccagcgcgcgatgcgagctgaacgcggtgaagaacgccttgatgccgttgcgccacacccgccgcgggtccgtcggcagccgctgcacggcaccgtcgaactcggcgtcggcccgggcgatcaccggctcgagcagcgagagcaccaccgcctctttggacttgaaatagaagtagaacgtgggccgggatagcccggcgcccttggccaggtcgtcgaccgagatgccggcgaacggccgagtctccagcagtcgctcggcggtggcgaggatggcctgctcgcgctcgtcgccggtggggcggatggcgcgacggccccgcagggcgcgcgtctggccggcggtagtcacggccgctactttacacgccgtcgataaattcgacagggtgttgaccgcttcgacacggtgttgatagcgtggttttcatgactgaacaccttgacgtcctcatcgtgggcgccggaatctccggcgtgagtgccgcctggcacctgcagaaccgctgccccaccaagagctacgccatcctggaacgccgcgccgacctgggcggcacctgggacctgttcaagtacccgggcatccggtccgactccgacatgttcacgctcggcttccgcttcaagccgtggcggtcggcgaagtcgatcgccgacggcgcgtcgatcaaggcctacatcaaggaggccgcggtcgagaaccggatcgagccgcacatccgctaccggcaccgggtggtggccgccgactggtccgatgccgacaaccgctggacggtgaccgtggagcacgacggccagcgcagcgagatcacctgctcgttcctgttcgcctgcaccggctactacaactacgacgagggctactcgcccaccttccccggggccgaggatttcggcggcaccatcgtccacccgcagcactggcccgaggacctcgactatgcgagcaagcgcatcgtggtcatcggctccggcgccaccgcgatcaccctgatcccggccctggtgaactccggcgccgggcatgtgacgatgctgcagcgctcgccgacctacatcggctcgctgcccggggtcgacccgttcgccgagcgggccaaccggctgctgcccgaccggctggcgcacatggccaaccgctggaaagccatcgcgttcagcaccttccagtaccagctgtcccgcaaggccccggcttacatgcgcaagacgctgatgacgatggccaagcgccgcctgcccgagggctacgacgtggaaaagcacttcgggccgcgctacaacgtgtgggacgagcggctgtgcctggcccccgacggcgacttcttccgcaccatccggcacggcaaggccgacgtcgtcactgacaccatcgaccggttcaccacgaccggcatcaggctgaactccggcgaggaactgccggccgacatcatcgtcaccgcaacgggattgaacatgcagctgctcggtggggtgacgccgacccgcaacggcgagccggtcgacctgacgtcgctgatgacctacaaggggctgatgttctccgggatgccgaacttcgccatcacgttcggctacaccaacgcatcgtggacgctgaaggccgacctggtctccgaattcgtctgccggctgctgaactacatggacgccaaggggtttgacttcgtggagccgcagcacccgggcgaggacgtcgacgagctgccgttcatggacttcactccgggctacttccgccggtcgatgcacctgctgcccaagtctgggtcgcgggccccgtggcggctcaagcagaactacttcttcgacatgcggaccatccggcgcggccgggtcgacgatgagggcctgaagttcgcgaaaaagcgtgcgccggtagcggtttagtctcctacagcgacgacgatcccgtcgtcgtcgctgtaggcgatgtcgccgggcgtgaacgtcacaccgccgagggtgatgtcgacgtcgcgctcgccggcgccggtcttggtgctcttgcgcggattggtgcccagcgccttgacgccgatgtccatgccgcgcagggcggcgctgtcgcgcaccgcgccgttgacgatcagcccggcccagccgttggcgcgggccagctcggcgatgacgtcgccgaccagcgccgtgtgcagcgagccgccgccgtcgaccaccaggactccgccgccacccggctcggagagcaccgatttgagcagcgcgttgtcctggaagcagcgcaccgtgctgatcggcccggcgaattcggtgcgcccgccgagctgacggaattgcaggtcgcagctgcgcacgtcgggcccgatgtcgtcgaccaggtcggcggtgggccgaaaggaaacggtcacgtcggcgctcagcggcggcgcagctggcggatgagcaggatggccagcaggctgacggcgacggcgacgatcagcggcaccggcgactgacccgccgccggccccacgaccgcgggagccaccgggttgtccgcggcttcgacggtcgacttcgcttgtgcggcagcgtctttggcggcggcggtcaggtccccgttggtgtcggcccgctgcccgccgccggtgggggtgttcttggccggcgccttcttcgcgggggccttcttggcgggtgctttcttggcgggcgccttcttcgcaggtgccttcttggccggcgctttcgcggtcttcttggccgccttggcgggcggtttcttctccggcgggtcgccggcgccgtcggctgcgctgttggtggggtcctgcgggtctgccatgcggccgctcctcgaccttcctctgtcgtcgttccctggctcaccggggtcttcgacccatcatgccaggacgccttccgccgcccgggccgccggtcatcgcccgcgccgggccgcccaccaggcgcccccggcgatcagcgccgccgcggtcgccacgaacggccagaccggcaccgcgccgccacccccgccggcgtgcccggccgcggcgggccccggcgtgccggtgccgggcacggtcagccggaacgaccgggatcccgacaccacgtggccgtccgcggaggtcacccggtagttggccgtgtaggtcccggccggccccagcgggcgcaccgccacgctgaccaccgcgccctgcacggtgggctctccggtggaccacacgttgccgtccggcccgaccaccgtcatcgcggcgaaggtggtttgcagctgttcgttgaaggtcgcgctgacccggtgcggcccggtcgtcagcgccgcgtcggcggcggggtcggtcgccacccgggcggcgtgcgcccacgccgcgggcgcggtcagcccggcgatcaggaccagggcgccgacgcacgcgccaaccgcccagcgcctcatgcccgccggcggaccagggcgatcgcgatgcccagcgcggccagcaccagcgcggcgccgcccagccaccgcgcggcgttgtcggccgcggcgggtccgccggggtgctggtggccggccgccggcccggcggccagggcgagcgtcggggccgggtgctcgggctcgccgccgtcgggcagcggcggctgatcccacttgaccacggtgccgtcggcgtaggtctgggtggccggaaagctgacggtgtcggcgtcgggcagcttcaccgacagccggaacagggcgaactggtcgggcccgatgccgccgcccgcggcggcggtccaggtgaccgagcggacggtgccggatgccgcgtcccggtccagccgggccgtccagcccggcatggtctcggtgtgcgccgcggccacgttgggcagcgcgacggtcagcgcggtggtggcggccccggtgttcgattcgttgggcacctggaaggtgacgacggccatggcgccgcgcaccgggttgtcgctgccggcgtgcacgtgcgccgacgccatcggggaccaggccaccgatcccaggcacagggcggcgacggcgaccagcaggcgcggggcccggcgcttgcgcggcggcatgcgggtcagctcaacccgaggcgggccatcaggtccgcctcgatgccgtcgagctgcgaggagatggcggcgtgtgccgcccggcgccgggcggcgggcatgttctccgcggcggtcaccgcggccgccaggtcggtgagccgctcggagatggcggcgacgaactgcttggtctcgccgtccttgggtttgcgttcctgcaccagccgcaacgacttctccgccccggcgatgcgggccgacagctgggcgccgtggccggagaactggccgatctgggccaacgggacgcccagccgatcggcgcggcgctggtcgatcagcgcgcgcgccgagacggcggcgcggtagacgagcggggtgaggatcggggcgagcagccgggacaccgtgaggatccgccggattcgggtgggcgacaagatcttgccctcccgcgcggccttgagttcggcctcggcgactttgagggcgttgcggtcgctgtcgcgctgcgccttgatctgcgccttgagcgccttgtcctgggcgcgcagcgcggatttggcgcggcgggcctcgttcttggcggccagcttggcctctagcttggcgcgggccttgatcgcgcgggcttcggcgcgacgcgtcgcgcggctctttcgcttgcggaacaggcccattccctcaccgctccccggtaatttcgctggcaatcgttctctgacgctctcgcgttgcgcgatccgtgagccaaccctaatgggaagccaaccctaatgggaatgggcgggcggcagcccgccagggcaggccgggacgggcgctgccgggccggggtgggcgtcaggcgtccaggtgctccgcgcgacgcagctcgttgacccgatccatgacctcgcgctgggcctcgggcgagagctcggcggtgcgcatcgcgatgcggcgcacgttgtcatcgcgcgacatggccagccaggacagttccgcgtcgagcttttcgtagtactcgtcgtcggtgaagtaggccggcttgatgcggaagaagttggccagcgcggccatggtggccgacgacgggttggtgcggttgcccgaacgcagctgggacaggtagggagccgacatcgtgatgccctccgccttgagcgccgcgatcacttccgcggaggtgtgcggaccccgtccgggcggatacaccgtgtcgaacaggcggttcaggcgagcagcgaatgtcgtgctcatggatatgacctccacggggctgtagaagttaactgttacctaggtgtatttgctgatcatggtagcgaggcttggtaacggtaaccaggtgcaaacccatggcgattcccgagccgcatagctgacgcccaccaactccccactcaacgagcgtctaactgattcgctggggtgtccactaaatcggtgaaactcacaggttatccgcagaattggacacccgtcccgaagtggcgggcatgtggcccgttgacggtcgtgctgattaccgcgccggtgctgggcaattgcgccgcaacgagccgcggagcggggacgaacccccggaccctttgctgccgaacgtaaccacggggccggtcagccccgtcgcgcggcgccgcacgggccggcgggcatcgaaaagggggaacggcgcagtcgttaggcggcgagcagcatcgccaggatcgcggtgtccgggtggctgatcgggtcgacgcccacccggctcaccatcgaggtgatggtgccgtcggcctcggcttccacccaggcggcccggtgttcgagcccgaggtagggcaggccgggcagcaacacgcatcccgacgccgcgcccgtgcattcgggcagcgacggcatggtctccgacggcggatgcagcatcagcagggcggggggttggtggtcggcgaaatggcctggcgggattgctgattcaccgaaaacggtgccctcggccagcaccaggccgaccgtgccgggctcgggttcgtcgggcagttcctcgcgggcgccgaacaccgttgtggtggagagcaatccgggcaacgacgccacccggaccgcgaccatgagcagctgcgcccactccttggtggaatccggccagcgtccggagatcacgaaccctttgagggcaccacgagaatggaagggggacaccccgataggccgatccgaccctgtttccatttcgacctccgcgcgacgcctccgctatggaaatgaccacactggcagctcgaataatcaagcatgcctgcggtttcggcggctggcaacacgacacggccgcgaaacgacgagggcgccgcgcagcgcgcgacgcccccgccgatcgagaggaaagtcagccgaagatcaggccttgggccttggaagtggcggcggcgtaccgcttctgcacgtccgcccagttgaccacgttccagaacgccttgacgtaatccgccttgacgttcttgtactgcaggtagaacgcgtgctcccacatgtcgacctgcagcagcgggatgatgcccagcgggacgttggcctgctggtcgtagagctggaaggtcagcaaccggctgcccacggtgtcataacccagcaccgcccagccggagccctgcaggccgttggcggcggcgctgaattgcgcccggaacttgtcgaaggagccgaacgcgtcgtcgatcgcggcggccagctcgccggtgggcttgtcaccgccgtccggcgacaggttcttccaccagatcgagtggttgacgtggccgcccaggtggaaggcgaggttcttttcgttcaggaagatcgcagcgtggtcctcgttggcgcgggcctcttcgagcttggcaagagcgtcgttcacgcctttgacgtaggtggcgtggtgcttggtgtggtggatctcgttgatctgccccgagatgtgcggttccaacgctgcatagtcccagtccaggtcgggcagggtgtattcagccacggcattcctttcttcgattgtcgtcttgacgctcagtcgcgcgggccacctcgcggcggccgggcgttatcaaccctgctccatgaccgcgcgcaccgcaagaacgaccccgctgagccggaaggcggatacccgctcagcggtgtttcaagacaggacttcaagacaagacgatgagggccaataccgccagcagcgccagtgcgatcaatccggcgcgcagtgccgcgacgctgtagctgtggttccacgcgggcgagccgccatacgacttcgacggggccggtgatcccggaccgaacgaatgcgtggccatcaaacgcctttcacccccggtcacctcgccaagtgaggtgagtcacaaacacctttcgagaacgcgatcatagcgctttgtcacgaggttgcgaaataagcccctgacctgcgagttgcccgataacggcaggtgcgcgggcggggccgggccgaaggtgcggcgccggaccggaggtggcgtcggcggtggttagccggccaatccatttcgctcggtgggaggcttgcggcaacgcgacggcgtgcataagaaaccgggtgttatccacagtgacaccgcggttagccgccagaggcagtagcgatgcctatccataccccctggggcggtgtggataaacctgtggaaactgtggatagtgtgcggcggtcggcggcgttgcccggccgggcggcgatcgtcggcggcgctagtctggtccggtgatccaggtgtgctctcaatgcggcacccgctggaatgtgcgcgaccggcagcgcgagtggtgcccgcgctgtcggggtgccctgatggcgcccctgcccgacgccccgccggccggtcccgcgcgggctccggggtggcagcgcacgccgccgcggctgccgcccggctaccggtggatagcgctgcgtcccggcgcggcgccgccgccgcggcgcggccgtcgtcccctcgggcccaccccccgctacgcggtgattccgcgctgggggctggccgaccgcgtcgagccgcccgccgtcgcggccgcgtccgcgcacccgggaccgccggcgcagctggtccgcaccacgtccttcgtcggcgtgctggtgctcggtatcgccgccctggtctacgtcgtgcgctacctgctgctggtgatcaaccgcgacactttgctgtactcgtgggtggcgatcggcgccgactggctcggcgtgctggccagtgtgggcgcggtgggggcggtgatcgcctccggcgtggcgctgatccgctggatgatcgcgcggcgcgccgcggtgttcgcccaccacggcctgcccgacccgcgctcggcgcgggcgttgtgggccggctgcgtggtgccgctggccaacctgctgtgggcgccggtgttcgtgatcgagctggccctgctggaggagcactaccaccggctcaaggggcccattctgcagtggtggatcacctgggtgtgcagctacgcggtgtccgtctcggccatcgcgaccagcttcgtcaccgacgcccagggcatcgccaacaacaccatcctgatggtgttcgggtatctgttcgccgccgccaccctggccgcggccacccgcattttcgagggattccagcgcaaacccgtggcgcggcccgcgcaccgctgggtgatggttcccgacgacggcccgcccccgccggcgccgggcgccccggttgagttcaagggccaggaaccggcagcataggggtatgacgtgggccgacgaggtgctcgccgggcatccctttgtcgttgcccaccgcggcgcgtcggccgcccggcccgaacacaccctggccgcctacgacctcgccctcaaggagggcgccgacggcgtggaatgcgacgtgcggctgacccgcgacggccacctggtgtgcgtgcacgaccgccggctggaccggacctcgacgggggccgggttggtcagcacgatgacgctggcgcagctgcgtgagctcgagtacggggcctggcacgacagttggcgcgaggacggcgcgcacggcgacaccagtttgctgacgctggacgcgctggtgtcgctggtgctggattggcgccggccggtgaagctgttcatcgagaccaagcacccggtccggtacggctcgctggtagagaccaagctgctggcactgctgcaccggttcggcatcgccgcgcccgcctccgccgaccggtcccgcgcggtggtgatgtcgttttcggcgtcggcggtgtggcggatccggcgggccgcgccgctgctgcccaccgtgctgctcggcaagaccgcccgctatctgatcagcggggcgccgacggcggtcggggcgaccgcggtggggccgtcgctgccgacgctgagggagtatccgcagctcgccgaccgcgccatcgcgcagggccgggcggtttactgctggaacgtcgacgactaccaggacatcgacttctgccgcgacgtcggcgtggcctggctggccacacaccacccgggccgcaccaaggcgtggctgcagggccaccgcgacggcagcggctagctcgacggctgctgttcgtccgtgctgccggccggcagctgcccgtcggaggacaacgcgtcgaacagccgggccgcccgcgcgtggtcccacaccaccaccgagccggcgtcgccgctggtgaactcgccgatcgggaccgtcaccgtggcgggggagccgtgcagcgcccagccgagccgggccaggtcccaggcgtggtcggcgcggtccacggtcagcgcgtcggcgaccgcgcgcggcgccgcgtaccagcgccacgggttgagccagacggtggggctggccgcacggtgcagcagcgccgcgacgaactgccgttgattgaccatccggtccagatcggcgcgcggggtgtcgcggctgcgcacgtagcccagcgcgttgcggccgtccagcgtctggcagccggccggcaggtcgaggccggccagcgggtcgtgcatcggcgcctgcgagcacaccctcaccccgcccagcgcatccaccagggcggtgaacccgccgaacccgatctcggcgtagtgcgcgatgcgcagcccggtggcctgctccaccgtgcggaccagcagagtcgccccgcccatggcgaacgcggcgttgatcttgtccttgccgtgctcggggatcggcacgtaggagtcgcgcggtatcgacaccatcgtcggcgccacgccggaccccaccccgggaaggtggaccagcaggatggtgtcggtgcggccgtcgccgatgtcaccgccggtggccagctgctgttgctgctcggcgctcagaccctggcggctgtccgagccgacgatcagccagttgctgccgcggcccggctcgggacggcccgggtagtcggcgagcaccggctcgcggtgcagcttggtgtcgaaccaggccaccccggcgcccaggccgccgccggccagcagcagcaccaccagcagggccgaggccaccgtcctgacccaccggcgcttgcgccgggggcgtgccgggcgtatggctgatgcgggtggcgcgggccgtgcgggtggcgcgggccgtgcgggtggggcgggcgggggccggtgcagcggctgggtgggcgcgtgcggcgagggcgccggaccgccgggccgggggatcaccggcgacggctcggggccgggttgacgcggcgggccctgacggcccggccgccggccccgcggggggaagtcgccgttcacccggccaacctacgtggccggggccgccccgcgcgcggacgacgccgtccgggtcagccgcgggcccgcaacccgttgatgaacgggcagcccatcagcacccggatggcctggctcagcccggtcatgtcgtccaccggtttgtggaagggcagtcgcacgtcgtggtcgcggtcgttgccctcgacccggaaccgcaccccgtaacggtccaggcccaggggtcgcacctgcccgcgccgcaacggcgcgggcagccgggacaccagccgggacaccacgtcgccgtgggcggtgtccagatgccacagcaggtcggactcgagcgcgcagaacgggtcgggccgggccgcgagcaggtccgccacgtcgaccggctcagcgccggtcgcgtcggtgaccaccacggacgcgatctccagccgccgcagcacataccgcggctccgtcccgtccgcgcggcgcggggtgtcgacgcccagcagggcggggttggggcattcggcggcgatgacgtcgagcgtttcgaggatctgcgccgggtcgacctcgtgcagccgcccgcgcacccagaccagcgaccggaccggctcgcgcagcggcagcggcgcgtagtcggtcagctcgagcagcgccggcgcccccgcgacgggccgcagccggtgttcccgcgcgaccggcagcgccagcgcgaaggagccggcaaacgggccggtgccgatgaggtgatggacgggcgtgggaaccggatcgtcgtgttcgatcgccagcagcgcgccgccggcgcggacgcacgcgctgcggatccgttcggcagtggacggggcggggcaggtctgcggtaacacgattctcctttgtttaggtaagcctaagttaacttaccgcgtgtggcgtggcaagagtcttcccgccggcacgccgctagggttgggtccgtggcccgcatcgcttacctcggtccggaagggaccttcaccgaggcggcgctgcggcagatcaccgccgccggcctggtccccggacagggggcggacggtgtgcggcccacgccggtcgacggcacgcccgcggcgctggacgcggtgcgcgacggcgccgccgactacgcgtgcgtgccgatcgagaactccatcgacggctcggtgacgcccaccctggacagcctcgcgatcggctcgccgctgcaggtgttcgcggagacgacgctggacgtggcgttcagcatcgtggtcaagccgggactgtccgccgccgacgtgcggaccctggcagccatcggggtggccgccgcccaggtgcgccagtgggtggccgccaacctggccggcgcgcagctgcgcccggcctattccaacgccgacgccgcccagcaggtggccgaggggcgcgccgacgccgcggtgacctccccgctggccgccgcccgctgggggttggacaccctggccgacggcgtggtcgacgaacccaacgcccgcacccgcttcgtcctggtcgggccgcccgcgccgccgccggcccgcaccggcgccgaccggacctcggtggtgctgcgcatcgacaacgcgccgggcgccctgctggccgcgctcgcggagttcggcatccgcggcatcgacctgacccgcatcgaatcccggcccaccagaacgggtttgggcatctaccggttcttcgccgattgcgtgggccacatcgacgacgaacccgtcgccgaggcgctcaaggcgctgcaccgccgctgtgccgacgtgcgctacctgggttcgtggcccaccggcacccccgcgggggcgctgccgccgtcgaccgaggaagcggtgcgctggctggcggcggtgcgggacggcaaacccgaaccccccggggagtcgcggcggtgagcggccggttgatcctggtgcggcacggccagtcgtacggaaacgtcgagcgccgcctcgacacccggccgcccggcgccgagctcacgccgctgggccgcgaccaggcccgcgagttcgcccgccggtcgggccggccggccatgctcgcgcactcggtggccacccgggcctcgcagaccgcggcggtgatcggcgggcagctggcgctgccgcccgtcgagctgggcggcatccacgaggtgcaggtcgggcggctggaaaaccgcaacgacgacgaggcggtcgcggagttcaacgccatctacgagcggtggcaccgcggcgagctcgaggtgccgctgcccggcggcgaaaccggcagcgaggtgctggaccgctacctgccggtgctcaccgagctgcggctgcgctaccttgacgaccacgatttccacggcgacatcgtggtcgtcagccacggcgcggcgatccggctggcggccgccgtgctggccggcgtcgaggccgacttcgcgctggaccatcacctcgacaacgcccagtcggtggcgctgaccccgatcaccgacgggcggtggagctgcgtgcgctggggcacgctgacgccgccgttctaccccgaggccgccgagatccccgccaccccggtggccgacgcggtgcgctccaccaccgacccgatgggctgagcccgccgatcagacggcgagcgcgatgacttcggtgcaggcgcagcccacggcgtcgcagtcgatgacgaaggcgtgcggcatcaattcgggcgtgaagcagtccggctcggtgcattcggaccggtgcaacgcatggcgaatgatggtgccgtgacagtgatccaagcctgcccggcagtcgcggcagtctgtgctcataggtgagttcatagcaccgcgggccgacaaatccaggatgccgcgcccggggggtcaggcccaacccaactgatgcagccgctcgtcgtcgatgccgaagtggtgggcgatctcgtggatcaccgtgaccgcgacctcctcgatcacctgctgctcggattcgcacacgtccagcagcgccgcccggtagatggtgatggcgtccggcagcgcgccggagtagtcggagtcgcgttcggtcagcgccacgccctcgtacagcccgagcaggtcgggctcctcggggtggcggtcgtcgaccaggacgacgacgttgtccatggccgcggccagctcgggcgggatcaggtcgagggcgtcggagaccagttcgtcgaaccgctgcggatccatccgcacgggcacggcggctagcctgccggcgggggcccgcccggcggggcctccggcgcgggcgggggaggcggagggggcgccgcgggcggcggaaccggcgcgggcggggcctcgggtgccgggttggccgggggcggggcgccgttgtcgaccggcggcggcggggcctgcgggggctgggtcaccaccggctgctggccgggcaggtgctggttgttccgcggcatctccggggcggcggcggagccggactgggtcgacggcgactgcgccggagcctgcaacgggatgggcggcatcgacagccgctcctcgggaatgtcgggcggcggcaccgggggctggccgttgatcagcagctgccccttggcgctgttcagcagcgtggcccagccgccgttgcccagcgtcgcgccgatgctgcaggccacctcgcggctgccggccgtccagctggccagcggcacggtggggtagatcagcgtcagtgtggtggtgcgcagcttgaccggcgccaggtacgcgtcggtcatcttggtgcaagagtccttgatgaaggcgtcctggtccggctcggcgggcagcgcgccggggaacttctcggccaggttgaccgtgccggtcacctccatcgcgtgcggggccgcgcagtccaccggcacatcggtgggctggttggttgccgagtcgatgcccaggcaggtgccggccggccagatcttggactggtcgacgtcggcgaccttgcccttgaacacctgctgctggttgttcgcgccgggcagttgcaggccgcacagcatgcggcgatccccaccctggcgccaggcccggtcgccgggccacagcaggctgacggtgaacttgctgttcgggtcgaacttggggcccaggtagttgcggacggcggcctcgcactgctcctgggtgatctgctggatgcgggccggggtcggcggcgcggcgttgggcccgtactccgagccggggaaggtgcgcatgtcgatggattcggcgacctcgaacttgtggtcgtcgccgcagttgacgatcttcgccgactccggggtggtgtcgggccacatcaggcattccccgctggcggcccggttgaaggcggcgtcgctcttggcgccggtgctgcgcaccgggctggcgtccagcagccggccggacccggttccgccgaccgggagcgcggtgaccagcccggcgatcagcaggccgccgagcgcggtcagcagcagcgcgcgccgggtcgcgcgggcctgcaggctgcgcggccacaggaaggccgaggcggcggtcgtctcgaccgcgggggcttccccggcttccggaaggtccttctcgggcgcttgcgacatcggctccattctgacagcagcgccgcagcgccgttacaaaagttactgatgtgagtcctgaggctccaggggggtgctgcgccggtcggccgggccgggtgaaagtaggcttcgggccgtgatcgacctgaagctgctccgggaagaccccgacgccgtgcgccgctcccaacaaagccgcggcgaagacccgtcgctggtggacgcgctgctggccgccgacgccgcccgccgggccgccatctcgaccgccgacacgctgcgcgccgaacagaagtcggccagcaagagcgtcggcgccgcctcgcccgagcagcgcccggccctgctggcccgcgccaaggagctggccgagcaggtcaaggccgccgaaaccgcccaggccgaggccgaggcggcgttcaccgccgcgcacctggccatctcgaacgtcgtcatcgacggcgtccccgccggcggcgaggacgacttcgccgtgctggacgtcgtcggggagccaacggcgctggaaaacccccgcgaccacctggaactgggcgagacgctgggcctgatcgacatggcccgcggggccaaggtgtccggttcgcggttctacttcctgaccggcaagggcgcgctgctgcagctcggcctgctgcagctggcgctgcgcctggccgtcgagaacggcttcgtgccgatgatcccgccggtgctggtgcgcccggaggtgatggcaggcaccggattcctgggcgcgcacgccgaggaggtctaccggatcgaggccgacgacctctatctggtgggcacctccgaggtgccgctggccggctaccacgccgacgagatcctggacctgtccgccggcccgctgcgctacgcgggctggtcgtcgtgctttcgccgcgaggccggcagctacggtaaggacacccgcggcgtcatccgggtgcaccagttcgacaaggtcgagggcttcgtctactgcacgcccgccgacgccgaggccgaacaccagcggctgctgggctggcagcgcgagatgctggcccgcatcgaggtgccctaccgggtgatcgacgtggccgcgggcgatctcggctcgtcggcggcgcgcaagttcgactgcgaggcgtgggtgcccacccagcagacctaccgcgagctgacgtcgacgtcgaactgcaccaccttccaggcgcgccggctgtccacccgctaccgcgacggcggggacgccaagggcaagccgcagatcgcggccaccctgaacggcacgctgggcaccacccgctggctggtggcgatcctggaaaaccaccaacagcccgacggcagcgtgcgggttcccgaggcgctggtgccgttcgtcggcaccgagctgctcgagcccgtcggcccgcgcggctaggacgggcggggggcgagccggcccggggtgtgcccgaacgcgcgtcggtaggtgtcgatgaacgcactcggtgtggcccaaccgcattcggccgccaccgaggtgacgtcgcgccgctcggccagcagcaccagggcgtgttgcaggcggacctgggtgcgccactgcgggaacgtcatggccagctcgtcgcggaacagccggctcagggtgcgctggccgaccccgatgcgctcgccgatctggcgcagcgtcaacggcttgcgcaggttgtcggccaacagtgcgcaggcggcgcgcagccggccgtccacggcggtgggaatccacagcggttcggcgacgctggtggcctgcaactggtcgtgcagcaccgccagcatccgctggtgcgcgccggcgtcggtgtcccgcgcccgcgaacacgcgatgatcagctcgcgcatcagcggagtgaccgccagcaccgcgggggcggccgggccgcggcggtagcgggcggggtccagcgcgacgccgtgaaagttggtgtggccgtggaacttgtgctcgtgccagcagcccgccgggatccagatggcgcggttggccggggtgatccaggtgcccgccggcgtggtcaccgacaccgcgcccgtggacggatacacgatctggtgcagcggatgccggtgccgtgcgatccgcgcccccggcggcagcgtctgcgccgaggtcgccagcccgtgctggccgatttccgacatatcgaggcaggatatcggaagcccgcagcattgcgtccgcctaacgtcgagatcgaccgacagaaaggcgtgatcgcgatggcgatgaatctcttgcaccggcaccggtgcagctcggccggctgggcgaaggaggtggccgacgagctgctgccctgggcgctggacggtgtcgaattgggttcccgcactttggaaatcgggcccggctacggtgcgacgctgagcgccccgctggatcgcaccgcctcgctgaccgcggtcgaactcgacccggtgatggccgatcggctgcagcgccgctacggcgaccgggcccgcgtcatccaggccagcggcaccgaaacaggtttgcccgcaaaccatttcacctccgtggtgtgcttcaccatgctgcaccacgtgcccagcccgcagctgcaggaccagctgttcgccgaggcgttgcgggtgctgcaacccggtgggacgttcgccggcagcgacggcgtgccgtcgtgggcgtttcgcctgctgcacgtcgccgatacctacaacccgatcgcgccgaaggacctgccgggccggctggcggccgcgggcttcgccgacatccacgccgacgcccggggcggccggcagcgctggcgggccgtcaaaccgatcgactaggcgggcaccgtctcgcgggcctgctcgtgccggcgctggcgttccatcgtcgcgaagtagaaggcgaacgcgaacgcgaagctggtgaacaggctggacacgaagtacagccagggccggcgcaacccgcggcggtagccgtccacgatggtgaacagcggcagcagcaccacgttcgcgatcgtgtagtcctggctggccgagctggcggccgggttggtgaacatcagccggatgtattcggcccagctgccgtgctcgccccacagcgggttggtcgatccgtgcgaatactgctgcacgaaggtgatgttgaagtaccagccgagcgcgaccgaggcgatgccgacgaggtagtacacgacctccatcggcgagaacagcggaccgccggcggggcgggcgaacaccttcgcgttcgaggcgacgatccaggcgatgacggagaacccgagaactgcgtgcacgagaagcgagaccatgcgcgcagtctcaccccggccgtgaagttttgtcaatattgtcaaaaggtttcttggtaccttactgccatggtcaggccggcgcagacggcgcgcagcgagcgcacccgggaggcgttgcgccaggccgcgctggtgcgatttttggcccagggcgtggaggacacctcggccgaacagatcgccgccgacgccggggtgtcgctgcgcacgttctaccgccacttccgctccaagcacgatctgctgttcgccgattacaccgggctgcactggtttcgggccgcgctggacgcccgcccggccgacgagccgatcatcgactcggtgcaggccgccatcttctccttcccctacgacgtggatgcggtgaccaagatcgccgcgctgcgccacgaggagctcgacccgggccgcatcgtccgccacatccgcgacgtgcaggccgacttcgccgaagccattgcggcgcaactacaacggcgcggccgcggcgccggcgcgccgacggccgaccagcgggtgcgcgccgcggtgaccgcgcgctgcatcgcggccgcggtgttcggcgcgatggaggtgtggatggtcggcgacgaacgatcgctcggcgaactcgcgcggctgtgtcacgcggcgctggagtcgctgcgcgcggggatcaccgactcctggagcaccgccaccgcgccccaagtttcgtcataattgacaaaacttggggcgtcgtgcgagcctccttgcggaggtcgggacatgaatgactacgacgcgatcgtcatcggcgcgggccacaacgggctgaccgccgcggtgctgctgcagaaggccgggctgcgcaccctgtgcctggacgccaagctctacgccggcgggatggcctccaccgtcgagcttttcgacggctaccggttcgagatcgccgggtcggtgcagttcccgacctcgcaggcggtggtcgacgagctgggcctggacaccatcccgacgatcgatttggacgtgatgtcggtggcggtgcgcggtgtcggggacgatccgctggtccaatacagcgacccggtcaagctgttcacccacctcaacgaggtgcacggggccgacgccgtcaacgggatggccggcctgatggcgtgggcccaggccccgacccgcgcgctgggccggttcgaggccggcacgccgcccaagagtctcgacgagatgtatgcctgcgccacaaacgaattcgagcgctcggcgatcgacgacatgctgttcgggtcggtcaccgacatcctggaccgctacctgcccgaccgcgagaagcacggcgccctgcgcggctcgatgaccgtgctggccgtcaacacgctctatcgcggcccggccaccccgggcagcgccgcggcgctggcgttcggcctcggcgtgccggacggcgacaccatgcagatgaagaagctgcgcggcggcatcggcgtgctcacgtcgcacctgtgcgacgtgctggagcgccacggcggcgaacttcggttgcgcaccaaggtgaccgagatcctggtcgagcacgccgggtccgggggacgggtgaccggggtgcgcaccgagtcgggcgagacgctgagcgccccgatcgtcgtctccggcatcgcgccggacgtcacgctcaacgagctgctcgatccggccgcgctgcccgccgacctgcgggcgcgctatgcgcgcatcgaccaccgcggcagctacctgcagatgcatttcgcgctgcaggaggcgccggtgttcgccgcgccgtaccaggtgctcaacgagcctgtcatgcaggcctcgatcggcctgttctgcacgcccgaggaggtgcagcagcagtgggagcaggcccggcgcggcgtcgttccggccgacccgaccgtcgtgctgcagatcccctcgcagaacgatccgggcctggccccggagggcaagcacgccgcgtcggcgttcgcgttgtggttcccgatcgagggcgaggtggactacggccgggcgaaaatcgagatggggcaacgggtgatcgacaagatcacccggctggcaccgaatttcgaggacagcatcatccggcacaccaccttcacgccccggcacatgggcgtcatgttcggcgcccccggcggcgactactgccacggcctgctgaacgcgaaccaggtcgggcccaaccggcccggtccgcgcggcttcctcggccagccgatcccgatcgagggcctgtatctgggcagcgcgggctgccacggcggtccgggcatcaccttcatccccggctacaacgcggcccggcaggcactgaccgaccgcagcggctgagtcaggagccgcgccgggcgagcaattcgtccagcagggcggtgaactcgtcgggccgcgccggcgtgaaggccggggcgggccgggtgcccggcacgtccagcgtgatcaacgtcgacttgaacggccggccgatgtccagcggaagccagcggcgcagatccgagctgccccagactcggaaccggtgcatgaagatgcccagcggctcggctttgtacccgcggatcgcgtccagcgcgatcaccttggacgtgcccgacggaaagtggtagcggcgcaacgtgatcgccgcccggtccaactggaccaggccgtcgtcgtaggtctcgttcacgcccgcgaactccgcagctggtgccccttcgcggtcaggcagcgcccgtcgtccagccgccactgccacccgtgcaggttgcacgtcaacgtgttgccctctaccacaccgaattttgaaagatcggccttcaggtgggggcagcggcgctgaatctcccagccgtccaacgtgatcgacgccgagttgtcgtgggtttcggcgaaccagccgtcggcgtaggcgattcgttcgtcggtcaggcatttgaagaaggtgtacaggtattcgttgtagccgccgacgcgccaggccttgaaccgggtggacaggaagatggtgttgacccagtccggctcccgatcgcgcagcacggtgcgcaccagctccggtgctatggcaaagccgtagcggaccttctcgtccggaatcggttctcgtaccgtgcgtttcgggaaatccaggatcacccgctcgggcccgagcaccagctccaccgggtagccgatgccgtcgcagatctcgtcgctttgcgacatgatcggttcgaacagggcgcgcagcggctccagcagcggctcgccggtggccggcgcccagccggcccgctccgcggcgatcaccggcgccatccgctcggcgtaggcggcgatgtagtcggccttgccggtggcgaagatggcctccacctcggcggtgggcagcggatgatgcagcgagttcagggtggatccgctgaagtcggcggtcgagccggggatcatcagcaggccgccgccttgcccgtgggcgcgcaactgctccaaaaacaccatctggtcggggaagatgttggccgggtcgccgtggtcgtcgttgaggtggcgcaactccggatccaagaagcagggcggcccggccgagggcaccacccacgtcgcccccacctgggcgaggtactggcgggcgcggtccatctggcgctgccgcttctggatgccgaacgactccttggcgcgggccggcatgtcgtagaccatcggataccagatggccccggagtactgcagcaggtgcacgtcgatgtgcccgaattcggacgccagcatgtcgagttccaccggccgggcgtcgttcatgttgaaaagcgttgtgctgccgtcggatacgaccagcgccgaatcgccgatcgggccgtcggcgggggcgcgcagggcgatgatcatcacatcgaggccgccgacccggtgcttgaccgagtcggccgtctcgaagaaccgatgaaaacccagctcctgcaatgcgtttcgcagatccggcaccggaaactccggcagcagcaccaccgcgtccttgttgacgtgctcggccaggttcttcgcgtcgaagtggtccttgtgcaggtgcgacacgtagaggtagtcgcaatcgcccagctggtcccagtccagggtgctgttgtccgggaacgggaaccaggacgcgaagtaggcgggattgacccaggggtcgcacaggatgctgcccgcctgggtccggatcagaaatccggcgtggcctacgctggtgacctgcacaaataccttccggggggacgtcgggcctgccgaggggtgtacggcgtctgcgcccccgagcctagcgcgcggcgacgtcccggtcctcgtcgtcggcctgccacaaccgccggtagtagccgtcgggctcgacgccgcccagctgatcgacccgcacggacggcaaggcagcggtcaactctttccggcgtttgaggcggctcacggtccggcgcactaggctggacggctgtagaaccggtgtacgggactgtcatacagcttgcccgcctgatctggcgcgtccagggcctgaagatcacgatcacgggcgtggagaacctgccgaagagcggcggtgccgtcatcgccatcaaccacaccggctacctggacttcaccttcgcgggtctgccggcctacaagcagggcctgggccgcaaggtgcggttcatggccaagcaggaggtcttcgaccacaagatcaccggacccatcatgcgcagcctgcgccacatctcggtgaaccgccaggacggggccgcctcctacgaggcggcggtgcgcaacctcaaagacggcgagctggtcggcgtttaccccgaggccaccatcagccgcagcttcgagatcaaggagttcaagtccggtgcggcccggatggccgtcgaggccggggtgccgatcgtcccgcacatcgtctggggcgcccagcgcatctggaccaaggaccaccccaagaagctgtggcggcccaaggtgccgatcatcgtgctggtcggcgagcccatccagccgaccctgggcgtcgaggagctcaaggggctgctgcactcgcggatgcagcatttgctggaacgcgcgcaggagatgtacggcccccacccggccggggagttctgggtgccgcaccggctgggcggcggcgccccgtcgctggccgaagcggcccggttggacgccgaggaggcggccgcgcgggcggcgcgccggggacagtccgcaggggcgccggagtagtgatcgatggtggagccgaccttccgcgccctcgagctcctggctgcgctggcggtgaaggccaccggcaccgagatcacctaccacggtgaggagaacatccccgagcgcggcggcgccgtggtggcgatcaaccacaccagctacgtcgacttcctgcccgccgggctggccgtgcatcgccgggggcgacgcctgcggttcatgatcaaggccgagatgcagcaggtgaaggtggtcaacttcctgatcaagcacacccgcaccatcccggtggaccgcggcgccggcggcggcgcctacgcggtagccgtgcagcggctgcgcgagggcgagttggtgggcgtctacccggaggccaccatcagccgcagcttcgagctcaaggagttcaagaccggcgcggcccggatggccatcgacgccggcgtgccgatcatcccgctgatcgtctggggcgcgcaccggatctggaccaaggaccatccacgtacactgggccgggccaagataccgatcaccgtgcaggtaggcgcgccgttgcgggcgcgcgaggacatcgcgcagaccgacgccgcgctgcgcgacgcgatgaccacgctgctgcaccaggcgcagcagcattacccgatgcagcccggggcgtactgggtgccgcgcccgctgggcggcacggcgccgacgccggcggaggcggcccggatggaggcagacgaggcggcggcccgagcggccgcggcagcggcgaagaaggccgcgaaccgggccgggcgtccgggccggtagcgaaggagaagagatggccgaggggttctaccggctgggggagtgggttgttccgccgctggtcgcgatgcagggaaccaagttcacctaccagggtttggagaacattcccgcccagggcggcgccctgctcgcccagaaccacaccagctacctggactggctgccgacgctgatggcggtgcgggagcggcaccgccgcgcctacttcatgatcaaagccgagatggccgacgtgaaggcggtcaactacgtcatcaagcacgcccggctgatcccggtggaccgcaggtcgggacacgacgcgttcgacgtggccgtgcagcgcatgcgcgagggtgagctgatcggcatgcatcccgaggccaccatcagccgcagcttcgaactgcgcgagttcaagaccggcgcggcgcgcatggcgctggccgcgcaggtgcccatcgtcccgatcatcgtctggggcgcccaccggatctggccgaaggaccacccgaagaaggtgttccgcaacaaggttccgatcaccgtggcggccgggcggccgctgccgccgcggggcacccccgagcagctcaacgcggcgctgcgggaggcgatgaacgccctgctgtaccgggtgcaggaggagtacccgcaccccaaggacgagttctgggtgccgcggcggctgggcggcggcgcgcccacccaggaggactcccgggcgctgcggctctccgagctgcaggagcggatgcgcaagtacggcaccgacggcgtcacccggccgggacagcgccagagcggactgcattgagcgccggccggcgaggcgggcggtttcgatgacgctgccgcggctcatcgcctgcgacgtcgacggcaccctgttcgacgacgacgacgagcggatcacccctcgcacccgggccgcggtccgcgccgcggtggccggcggcgcgcggttcgtggtggccaccggccgcccgccgcggtggatccgcccggtggtcgacgcgctgggcttcgcgccgatcgcggtgtgcgccaacggcgcggtgatctacgacccggcgaaggaccgggtgctgtccgcccgcacgctggacgtcgacaccctggccgagctggccgagctcgccacgcgggtcatcccgggggcggggctggccgtcgagcggatcggggaacgcgcccacgacacggcgacgccgcagttcatcagctcgccgggttacgagcacgcctggctgaatccggacaacaccgaggtgtcgatcgaggacctgctcagcgccccggcgatcaagctgctgattcgccgggccggggcgcgcagctccgacatggccgccgagctggccaagcacgtcggcctcgagggtgacatcacctattcgacggacaacggcctggtcgagatcgtgccgctggggatcagcaaggccaccggcatcgaagagatcgcccggccgctggagatcgcccgcgaggaggtggtggcgttcggcgacatgcccaacgatctgccgatgctgcgctgggcgggccacggcgtggcgatgggcaatgcccatcccgaggtgcaggccgccgccgacgagatcaccgccgccaacaacgacgacggcgtgggccgggtgctggaacgctggtggctttagcgccgcgacgatgcgcgccgcgtggcggcgcgaggaggagcggggcagtcggctttagcggggcggtcggctttagcgccgggcagcggccttagcgcttcgctacgtcgccgccgggtgggtcggcagcgagaagtgttcggccggaaccgttgggccgcttggcaattgggtggccagcggggtggtgatcccgtccagcacctcggtcacgttaccggtcagccgctcgtagttcagcgtgccgtgctggaagttctgggtaatctgcagcggctcttggatttccgcgctggtgggcaggccgagcgggccgcgctcgtagctctgtgagccccaggcgtcgtagatcgcgccggtgaccggctgggcgccggtctgcggcgaccagtacatcgcgccccggacgaaggtgacgaagcgggcgtcgtccgccgcgctgtcctccggcgcggtcggcgcccccagcacgctgttcatcccgccgatctcctgccagtgcgcgtagatcgccccaccctgcagcgccttgatcagctcttccggcggatcgttgacatgcgctgcgatatcccgtatctcgtccatcagcgcgtaggccgcgttgcccgggcagtcggtgttgcccacgtcgcggtgggtgaagatggtcggcagcgtggcgacggtgccggccgcgtaggtggtgtagtggctgccggcggactccagttgcacggtgcccttggggtcgacgccgtccatgcccaggcgccagccgagcagccggcccacggcgcgcaactgcaccggcgtcggcggcacgtcgtcgaagttgccgatcatcgccacgccccaggtgttgcggttgaacccgccggtgtggaacgcctcgaccgccttggtgaggccccctgcgctgccctcgaacacctggccgtacttgtcgaccagcgcgttgtaggcgatgtcgcaccagcccagcgtcttgctgtggtaggtgtagatggccttgacgatgccggccgattccagcggcgagtagtcgttgctgcccgcggtgtggtgcacgactgcggcgcgaatcccgttgtcgtactgcggacttccgcagcgcagcgattcgtcggcgccccactcggcccggctgatgatcggtggcgcctgcccgggcatcaccaccccggacggcggcgtccaatgcgtttcggacggcgcttgcggcggcgagatgagcacggccgagatgttctgcccgaacggttgctcccgcgaggccggcctgtagcccaggtcgtcggccgggcgcgggggcgccgggggcggctgggtcaccggcgcgtcgagcgggcgggtgaccgcgatctgcacggtggtggtggtgccgacgaagaccgggtccgtcccgcgcggcccctcggttgccccgccggcgtggccggggtcgggcgcggcggtttcgtactcggtctgataccagggcccccaggaaccgtcgcgacgccgggcgcgcaccctcgtcgacgtgccggccaggtcaccggtcagggcgaccagggaaaacggcgactgctggctgatctcgcgaaccgtgacgccggcccccagcccgatcagcggctgctcggtgagctgggtgccgcgggccggtggcgcggcggcggcgccgcggtcccgggtggcgtcgcccacccacgagacgaggacgaccgtcgccgcgatggcggtgagcagcgtcgttggcgcgcgactgcgggacaccagccgatgttacgtgtgattctgatgttatctatgagacgacacgacgttgagcgatgccgaaatccgcggcaaaaatcgacggcaccgcagaaccctctgcggtgccgtctggtggatggtttggaaaaggtctagaccgggggcagtgccggcgcggcgccggcggccgccggcaacgcacccgcggcgcccgccgcacccggcagggcgccggccgcaccgggcagggcgccggccgcgccgggcagagcaccggccgcgccgggcaaagcacccgcggccgcgccgccgtgcatgccctgcgtgatcgccggcatcaccaggcccttgagcaggtcgatcgcctgacccgcgccgagctggttggcggcttgcatcacgtcgttgaccaggccgccgctgccacccgagctcgagccgccgcccagaccggtgccaccgccgccgatcggcgaggcgttaccgaaggtcgacgggtcgcccaggatcgggtacgtgccaccggcgcccgggtccaggccggccccggagtcgatcggcacctcactcggcgccacggtcgggctgcccagccccggcgccgtcccggccgggctggtcagcccggggttggacagcgcggggttgagcccggcgccgggggtggcgaccccgccgcccggcgtggtcggcagcgcgccgggcgcggtgagcccgggcgtcgtcggcgccgcacccgggctggtcagaccggggctggtcaaaccaggactggtcaggccgggactggtcaggccgggactggtcgcaccggggctcgtcagaccgggattggtcaggcccggcgttcccaggccgggcgtgcccaggccggggctacccaggccggggctggccagaccgggagtgctggtggcgccgccgctcagggcgggcaccgggggcaggttgatcccaaactgcgacaggccctgcgacagcgcacccatcagctcgcccggcagatcgctcatcactgcggcctgcttgaactcgtggtgctcgggcgccttgttgccggccgtcgattcgtagacaaggaagtatgcgcaaggactcgccactgccagggcggcgaccgcgctcatggctgtcgaaagcttgcgtcggcgtcggttcggcacggaagtctcctctatctgactatgtgttgtgtcggcgcgccccgccgatgctgtctggcaggaatcacacacagtcgatggtacgagtgggaatcctattactagagtggtgatattgaatcgtgaggcaattgcgaccaggactgtgatcgccggaccggcacaccccgccggccgccgaatcagccgggccctggttgctggcctcgccaaatgggttcgggccacgccgtcggataccctaagcaaccgatgaccgctcgtttcgatcttttcgtcgtcggctctggattcttcggactgaccattgccgagcgcgtcgctacccagctcgggaagcgcgtgctcgtggtggaacgccgcccgcacatcggcggcaacgcctactcggaacccgagccgcacaccggcatcgaggtgcacaagtacggcgcccacctgttccacacctctaataaaagggtctgggactacgtgcggcagttcaccgacttcaccgactaccggcaccgggtcttcgccatgcacaacggccaggcctaccagttcccgatgggcctgggcctggtgtcgcagttcttcggcaagtacttcagccccgaggaagcccgcaagctcatcgccgagcaggccgccgagatcgacaccgccgacgcgcagaacctcgaggagaaggcgatctcgctgatcggccggccgctctacgaggccttcgtcaagggctacaccgccaagcagtggcagaccgaccccaaggaactgccggcgtccaacatcacccggctgccggtgcgctacaccttcgacaaccgctacttctccgacacctacgaggggcttccggtcgacggctacacggcctggctgcagaacatggccgcccacgagaacatcgaggtccggctgaacaccgactggttcgacgtgcgcgacgggctgcgcgcgggcagccccgaggcgccggtggtctacaccggcccgctggatcgctacttcgactacgccgagggccgattgggttggcgcacactggatttcgaggtcgaggtgctgcccatcggggacttccagggcaccccggtgatgaactacaacgacctcgacgtgccctacacccgcatccacgagttccggcacttccacaccgaacgcgactacccgaccgacaagacggtgatcatgcgggagtattcgcggttcgccgaggacgacgacgagccctactatccgatcaacaccgaggccgaccgcgccctgctggccgcctaccgggcccgggccaaggccgagaccgcgtcggcgaaggtcctgttcggcggccggttgggcacctaccagtacctggacatgcacatggccatcgccagcgcgctgaacatgtatgacaacgtcctcgcgccgcacctgcgcgacggcgcatccctgacagaagcccagagcaaacaggagagcggcgcctgatgcgcgccacgacgatgcagagcggagcgatgagaaggagtggcgcctgaatgagtgccgtgagcctgctgtcccggatcatcctgccgcgtcccggcgagcccctcgacgtgcgcaagctgtatctggaggagtcgacgaccaacgcccggcgcgcgcacgccaccagccgcacgtcgctggagatcggcaaagagtccgaggtgtcgttcgccacctacttcaacgcgttcccggccagctactggcggcgctggtcgatctgcgaatcggtggtgctcaaggtcgagctgaccggaaccggtcgcgtcgacgtctaccgcaccaaggccaccggggtgcggatctcggtgcagggccgccagttcgtcggcaccgacgaccagccggccgtcgtcgagatcgaggtgccgttgaagccgttcgaggacggcggctggatctggttcgacatcaccaccgacaccgaggtcaacctgatcagcggcggctggtatgccaccgaaccggcaccggggacggccaacatcgccgtcggcatccccaccttcaaccggcccgccgactgcgtcaacgcgctggctgacctcaccgcggatccgttggtggacaaggtgatcggtgcggtgatcgtgcccgaccagggcacccgcaaggtgcgcgaccacccggacttcccggcggcggccgcgggtctgggcaatcggctgtccattcacgaccagcccaacctcggcggctccggcggatacagccgggtgatgtacgaggcgctgaaaaacactgactgccaacagattctgttcatggatgacgacatccgcatcgagcccgactcgatcctgcgggtgctggcgttgcaccggttcgccaagacgccgatgctgatcggcggccagatgctcaacctgcaggagccctcgcacctgcacatcatgggcgaggtcgtcgaccagtcgaacttcatgtggaccgcggcgccgcacgccgagtacgaccacgacttcgcgcaattcccgttgaacgacaagaaccctcgcagcgcgctgctgcaccggcgcatcgacgtcgacttcaacgggtggtggacgtgcatgatcccgcggcaggtcgccgaggagctgggccagccgctgccgctgttaatcaagtgggacgacgccgaatacggcctgcgcgccggcgagcacggctaccccaccgtcacccttcccggcgcggccatctggcacatggcctggagcgacaaggacgacgccatcgactggcaggcctacttccatctgcgcaaccggctggtggtcgccgcgctgcactgggacggcgacatcaccgggctggtccgcagccacctgaaggccaccctgaaacaccttgcctgccttgaatattcgacggtggccatccagaaccgggccatcgacgacttcctggccgggcccgagcacatcttctccatcctggaatccgcgctgcccgaggtgcaccggctgcgcaaggagtacccggacgcggtggtgctgccggcggccagcgagctgccgccgccgcgctaccagagcaaggcgatgaagccgccggtgaacccgctgtcgatcggctaccggctggcccgcgggatcgcccacaacgcgaccaaggccgaccctgaggcgcaccggcgcccgcagtacaacgtgcccacccaggatgcgcggtggttccggctgtgcaccgtcgacggcgtcacggtgacgacggccgacggctgcggtgtggtgtaccgccagcgggaccggcgaaagatgttctcgctgttgttcgcatcgctgcgccgtcagcgcaagttgctgacccggttcgacgagatgcgcagggtgtatcgcggtgcgctgcccgtgttgtccagcaagcagaagtgggagacggcgttgctgccagctgccgaacatgcctgagtcccctgctgcgcaggccccacgcggtgaggtggccgcgctcgtcgccgtccaggcggcactgagcaagcgccccggggtgctgaccgtggcgcgcgcgctgtcccacttcggcgagcacagcatcggctgggtggcggcggccgcgctcggcgcgctgtgctcaccgcggcgccgcgccgattggcttgcggccggggccggggcgttcgtcgcgcacgctgctgccgtcgtcgtcaagcgcatcgtgcggcgcgaacggccgcatcatcccgccgtcgtggtcaatgtcggcacccccagccggctcagtttcccgtccgcgcatgccacctccaccaccgccgcagcgatcctgctgggccggatcaccggcctgccgctgcccgcggtcctggtgccgccgatggcgttgtcccggatggtgctgggggtgcactatcccagcgacgtggcctgcggcatcgccctgggggccggcgtcgccgccgtcgcgcgccgcgcaccgcagctggcaagaggtgaccaatgaccgaggaaacgcaggaagcggtggccggaccgccggccaacgtggtctccggggtgatcaaggcgatccgcccccggcaatgggtgaagaacgtgctggtgctgctggcgccggtggcggcgctgggcggcccggtccagtacgactacaccgacgtgctgggcaaggtgtcggtggcgttcgtggtgttctccctggccgcctcgtcgatctacctggtcaacgacgcgcgcgacgtcgaggccgaccgcgagcaccccaccaagcggttccggccgatcgcggccggcgtggtgcccgaatggctggcctacaccctggccgtgctgctggcggcggcgtcgctgggcatcggctggtggctgaccccgaacctggcggcggtgatggccgtctacatcgccatccagctggcctactgcttcggcctcaaacaccaagcggtgatggacatctgcatcgtgtcgtcggggttcctgctgcgcgccatcgccggcggcgcggccaccaacatccggctcacccaatggttcctgctgatgatggcgttcgggtcgctgttcatggcggccggcaagcgctacgccgagctgcaactggccgagcggaccggggcgaagatccgcaaggcgctggagagctacaccagcacctacctgcggttcgtctggacgttgtcggccaccgcgctggtggtctgctacgggctgtgggccttcgaccgcgagcacggcgaggcgcgctggttcgtggtgtccatggtcccgttcaccatcgcgatcctgcgctacgcggtcgacgtggacggcgggctggccggggagcccgaggacatcgtgctgcgtgaccgggtgttccagctcctggcgctggcgtggatggtgacggtcggagccgccgttgccttcggttagccccgaactgcaggcgctcaaggcgcgcatcatgggcagccggccggtgatgaggcggcccggctggccggtgttcccgtacacgacgatggtgcgctcgagcctgtggatcggcgtggcggtggttgccgtgctgttcgcctggggcggctggcagcggcgctggatcgccgacgacgggctgatcgtgctgcgcaccgtgcgcaacctgctggccggcaacgggccggtgttcaaccagggcgagcgggtggaggccaacacttcgacggcgtggacgtatctgatgtacgccggcagctgggtgggcggcccgctgcggatggagtacgtggcgctggcgctggcgctgacgctttcggtgctcggggtggcgctgctgatgctgggcgcggcgcgactgtacgcgcccagcctgcgcggccgccgggcgatcatgctgcccgccggggcgctggtctacatcgcgctgccgccgtcgcgggacttcgccacctccggcctggaaagcggtttggccctggcctacctggggttgctgtggtggatgatggtgtgctgggcgcagccggtgcgcaaccggccggaccgccgggagttcgccggtgcgctggcgttcgtcgccgggttcagcgtcctggtgcgtccggagctggcgctgatgggcgggctggcgctgatcatgatgctggtcgcggcccgcacctggcggcgccgggcgctgatcgtcgccgccgggggtgcgctgccggtggcctacgagatcttccggatgggctactacggcctgctggtgccgggcaccgccctggccaaggacgccgccggggacaagtggtcgcagggcatgacctacctgtccaacttcgacgcgccgtacctggtgtgggttcccgcggtgctgctggtgctgctcggggtgctgctggcggccgcccgccggcggccgtcgttcctgcggcccccgctggcgcccaactacggccgggtggcccgggcggtgcacagcccgccggcggtggtggcctgggtgctggtcagcggcctgctgcaggccctgtactggattcgccagggcggggacttcatgcacgcccgggtgctgctggcgccgctgttctgcctgctggccccggtggccgtcgtcccggtgatggtgcccgacggccaggactactcccgcgagaccggcaactgggtggccggcgcggcctgcgcgctgtggctcgggatcgccggatgggcgctgtgggcggccaactcgcccggcatgggcgacgacgccacgcacgtcacctactccgggatcgtcgacgaacgccgcttctacgcccaggccaccggccacgcgcacccgctgaccgccgccgactacctgggctatccgcggatggccgccatcctgaccgcgctgaacaacaccccccgagggcgcgctgctgctgccgtcgggcaactacacccagtgggacctggtgccgatggcccagccgccgcccggcaccacccccgacaagtttccgcaaaagccgcagcacaccgtctttttcaccaacctgggcatggtggggatgaacgtcgggctcgacgtccgggtgatcgaccagattggtctggcgaatccgctggcgcagcacaccgaacgcctcaagcacggccggatcgggcacgacaagaacctgttcccggactgggtgatcgccgacgggccctgggtgaaggtgtatccggggatcccgggttacctggacgcgcagtgggtcgccgaggccgtctcggcgctgcagtgcccggacacccgggcggtgctggcctcggtgcgggccccgatgaccccgcaccggttcctgtccaacgcgctgcactccttccaattcaccggctaccggatcgaccgggtgccgcgctacgagctcgcccgctgcgggctgccggtgccggaggaagcgccaccgccgccgcgcgagtgagcgccgcgcagaagaattttcggccgatccgccaccggtcgggccgcggcgtccgcgacaaattggcagcaacatcacatctgacccccgaccagctcgccacggcggtcaagcacatgcgccgacgtcgacttttgtacacgtgttggatgtgaaaaccgctgggttccagggccgctcggccgcaggcgggctcgcctcgatgcgaccgaacggccaccggtgtggttgactacacgagcactcctgcgcttcatgccatcggtaggcgcaggcggttcgaaccaatcaagaaagcggccgagcggacgaacgcgccggaacgccgcaagaaggatgaggaagcaaggatgacgcttgtcgacagattgcgcggcgccgtggcggggatgccgcgccggctcgtggtgggggccgctggtgcggcgctgctctcgggcctgattggcgccgtcgggggctcggcgaccgccggggccttctcgcgccccggtctgccggtggagtacctgcaggttccctccgccgccatgggacgggacatcaaggtccagttccaaagcggtggggccaactcgcccgcgttgtacctgctcgacgggatgcgcgcgcaagacgacttcaacggctgggacatcaacaccccggcgttcgagtggtacaaccagtcgggcatctcggtcgccatgccggtcggcggccagtccagcttctactccgactggtacaagcccgcctgcggcaaggccggctgcaccacctacaagtgggagaccttcctgaccagcgagctgccgcagtacctgtcggcgcagaagcaggtcaagccgaccggcagcggtgtcgtcggcctgtcgatggccggctcctcggcgctgatcctggccgcctaccaccccgaccagttcgtctacgccggctcgctgtcggcgctgctggactcgtcgcagggcatgggcccgtcgctgatcgggctggccatgggtgacgccggtggctacaaggccgccgacatgtggggtccgaaggaggacccggcctgggcccgcaacgacccgtcgctgcaggtcggcaagctggtcgcgaacaacacccggatctgggtgtactgcggcaacggcaagccgtccgacctcggtggcgacaacctgcccgccaagttcctcgagggcttcgtgcggacgtccaacctgaagttccaggacgcctacaacggcgccggcggccacaacgcggtgtggaacttcgacgccaacggcacccacgactggccctactggggcgcgcagctgcaggcgatgaagcctgacctgcagtcggtgctgggcgccaccccgggcgccggtccggccacggccgcggccaccaatgctgggaacggccagggcacctaaccaataccgagcatgacgccggcggcgggaacccttcggggctcccgccgccggtcgtttcgcgatggtgtgacgagtttcactacccggcgcgcgggggaactacggccctggctaatgtgctctcagcgactagacgatggagggtggacatgacggtcgtgcggggtgtgtcggcgcttcttcgggtgttctgcatcgccgtgctggcggcggggctgggcgtggcattgcagcccgccgcggtcaccggcgcggcccgggccgcgggctacgagagcctgatggtgccgtcggcggcgatgggccgcgacatcccggtggccttcctggccggcggcccgcatgcggtctacctgctggacgccttcaacgcggcgcccgacgtgagcaactgggtgaccgcaggcaacgcgatgaacaccctcggcggcaagggcatctcggtggtggccccggccggcggcgcgtggagcatgtacaccaactgggagcaggacggcagcaagcagtgggacaccttcctgtccagcgagctgcccgactggctggccgccaacaaggggctggccccgggcgggcacgccgccgtcggcgcctcgcagggcggctacggcgcgatggcgctggccgccttccaccccgaccgcttcggcttcgccggctcgctgtccgggtttctctacccgtccagcaccaactacaacggcgccatcctggccggcctgcagcagtacggcggcgtggacggcaacggcatgtggggggtgccgcagctgggccggtggaaatggcacgacccgtacgtgcacgcctcgctgctggcccagaacaacacccgggtgtgggtgtggagcccgaccaacatgggcggcgacgacgccgcgatgatcggccaggcgggcgcggcgatgggcagctcgcgggagttctaccagcagtaccgcagcaacggcgggcacaacgggcacttcgacttccccggcggcggcgacaacggctggggctcgtgggccggccagttgggcgcgatgtcgggcgacatcgtcggcgccattcgctagacggcgatcgccagcgcggcgcagccgggcgccgcgggtcgccaccacatggctagccgctcgcggccgggctgaccacccagggcgagccggtaccgtgtagagcgtgcagcagagcgcgggcgtcgcgccgctgcgtccacccgctctgccagcaggagaacatgcctaccaacgcccggcgcaagcgccgtcgcaccctggcctggatcgccgccctgtcggtggccggcgtcgtgttgttggtcatcgtggccgcggtcgtggtgctgcgtggccgcgaggcgccgcccagcgcggtgccgcccggcgtgctgccgcccacctcgacgaccggccatccgcacaagccgcggccggcgtcgcaggacgcctcctgcccggacgtgctgctggtcaacgtgcccggcacctgggaatcggccccgcaggacgacccggggaacccgctgcagttcccgaacgcgttgctgcacaaggtgaccgcgagcctcaccgagcagttcccgccgtcgcggttgcaggcctacaccactccctacaccgcgcagttccacaacccgttgagcggtgacacgcagatgacctacaacgccagccgggccgagggcacccgggccaccgtcgcggcgatgaccgacatgaacaacaagtgcccgctgaccagctacgtgctgatgggcttctcgcagggcgcggtgatcgccggcgacatcgccagcgacatcggcaacggccgcgggccggtggacgacgacctggtgctgggtgtgacgttgatcgccgacggccgccgccagcagggggtgggcaacgacatcgggcccaaccctcccgggcagggcgccgaggtgaccctgcacgaggtgcccatcctgtccgggctgggcctgaccatgaccggcgcgcggcccggcgggttcggcgacctcaacgccaagaccaacgagatctgcgcgccgggcgacctgatctgcgccgcgcccgaggaggccttcagcgtggccaacctgcccgccacgctgaacaccctggccggcggtgccggccaaccggtccacgcgctgtacgccaccacccagtgctggagcctggatggggtgccggccaccgactggacgttgaactgggctcacggattgatcgcgaatgcgccacaacccaaacacggatgatcggggcggccggacacagccgtcaggtggccgttgccgttggccatcggcggtaccttgtgatttggtctgccgtgggcggccccgtaacattaagaggaatttaagagctgccagactttgtcgcgggcccggtcggggtcgatgccggctggggctgcgggggctgcccgtgcgtgaaccgtgcgtggacattgcgtagacatgtagccgtcggcgcgcgccgaccggacaacaacgtcggcctggccgaccgaacacaggtgtgacaggagagcggaatggcgtaccacaacccgttcatcgcgaatggaaagatcaagttccccgagaacacgaacttggtcaagcacgttgagaaatgggcgagggttcgtggcgacaagctcgcctaccgattcctggacttctccaccgagcgcgacggcgtcgcctgcgacatctcctggtcggagttcagcgcccgcaaccgcgcggtgggcgcccggctgcagcaggtcaccgagcccggcgaccgcatcgcggtgctgtgcccgcagaacctggactacctgatcgcgctgttcggcgccctgtacgccggccggatcgcggtgccgctgttcgaccccagcgagcccggtcacgtcggccggctgcacgccgttctcgacgactgcaccccgtcgaccatcctgaccaccaccgaggccgccgagggcgtccgcgagttcatccgcgcccgctcggccaaggagcgcccgcgcgtcatcgccgtcgacgcggtgcccaacgaggtcaattccacctgggtgccgccggaggccgacgagaacaccatcgcctacctgcagtacacctccggctccacccgcaccccgaccggcgtggagatcacccacctgaacctgcccaccaacgtgctgcaggtgctcaacgggctggagggcaaggagggcgaccgcggcctgtcctggctgccgttcttccacgacatggggttgatcaccgcgatgctgtcgccggtgctcggccacaacttcaccttcatgacccccgccgcgttcgtgcgccgtcccggccggtggatccgggagatggcccgcaagcccgacgacgcccccgactgcgaggtgttcaccgtcgcgcccaacttcgcgttcgagcacgccgccgtgcgcggggtgcccaaggagggcgagccgccgctggacctgagcaacgtcaagggaatcctgaacggcagcgagccggtgtccccgtcctcgatgcgcaagttctacgaggccttcaagccgtacggcctgcgcgagaccgcgatcaagccgtcctacggcctggccgaggcgacgctgttcgtctccaccaccccgatggaccaggcgcccaccgtcatccacgtcgaccgcgccgagctgaacaagcagcgcttcgtcgaggtgcccgccgatgcccccaacgcggtggcccaggtgtccgccggcgtcatcggcgtcgacgagtgggcggtcatcgtcgacccggagaccgccagcgagctgccggacgggcacatcggcgagatctggttgcacggcaacaacatgggcatcggctactggggcaaggaagaggagaccaacgaggtcttccgcaacatcctcaagtcgcggatcagccagtcgcacgccgagggcgccccggacgacgcgatgtgggtcaagacaggcgactacggcacctattacaagggccacctctacatcgccggccggatcaaggacctggtcatcatcgacggccgcaaccactacccgcaggacctggagtactcggcgcaggaggccagcaaggcgctgcgcaccgggtatgtggccgccttctcggtgccggccaaccagctgcccaaagaggtgttcgacaacccgcataccgggctgaagtatgacccggacgacacctccgagcagttggtgatcgtcgccgagcgcgcgcccggcacccacaagctggactaccagccgatcgccgacgacatccgggcggccatcgcggtgcgccacggcgtcacggtccgcgatctgctgttggtgcaggcggggacgattccgcggacctccagcggcaagatcgggcaccgcgcctgccgcgccgcctacctcgacggcagcctgcgaagcggtgtcggctccccgacggccttcgccaactcaaccgactgagcatcaggaccatggctgacatagacgaacctcaggagaacacgcccgccaagaagagcgatatgcgcgccggcgacgatgcagagcgaagcgatgctgaggagcggcgcccgacaaccgtgcccgagatgcgcgagtggctgcgcaactgggtgggccgggccgtcgggaagtcacccgacgagatcgacgagtcggtgccgatggtcgagctgggtctgtcgtcgcgggacgcggtggcgatggccgccgacatcgaggacatgaccggcgtcaccctgtcggtggcggtggccttccagcatccgaccatcgagtcgctggccacccgcatcatcgagggcgagccggaggccgtcgacgccggcgacgacatggactggtcgcgcagcgggccggccgagcgggtcgacatcgcgatcgtggggctgtccacccggctgcccggcgacatgaacagccccgacgagacctggcaagcgctgatggagggccgcgacgccatcaccgacctgcccgagggccgctggtcggaattcctcgaggagccgcgcatcgcggctcgggtggcaggcgcccgcacccgcggcggctacctgaaggacatcaagggcttcgactcggagttcttcgcggtcgccaagaccgaggccgacaacatcgacccgcagcagcggatggcgctggagctgacctgggaggcgctcgagcacgcccgcatcccggcgtccagcctgcgcggcgaggcggtcggcgtgtacgtcggcttctccaacaacgactaccagttcctggccgtgtccgacccgaccgtcgcgcacccctacgcgatcaccggcaccgccagctcgatcatcgccaaccgggtgtcctacttctacgacttccgcggcccctcggtggcggtggacaccgcctgctccagctcgctggtggcgacgcatcaggccgtgcaggcgctgcgcaacggcgagtgcgacgtggcgatcgccggtggggtcaacgcgctgctcaccccgctggtgacgctcggtttcgacgagatcggccaggtgctggcacccgacggccggatcaagtcgttctccgccgacgccgacggctacacccgctccgagggtgggggcatgttcgtgctcaagcgggtcgacgacgcccgccgggacggcgaccagatcctggccgtgatcgccggcagcgcggtcaaccacgacggccggtccaacggcctgatcgcccccaaccaggacgcccaggccgaggtgctgcgccgggcctacaaggatgccggcatcgatccgcgcaccgtcgactacatcgaggcgcacggcaccggcacggtgctgggtgacccgatcgaggccgaggcgctgggccgggtggtcggccgcggccggcccgccgaccgtccggcgctgctcggtgcggtgaaaaccaatgtgggacacctggagtcggcggccggcgcggccagcctggccaaggtggtgctggcgttgcagcacgacaagctgccgccgtcgatcaacttcgccgggcccagcccctacatcgacttcgacggcatgcgcctgaaagtcattgacagcccgacggattggccgcgctacggcggctacgcgctggccggggtgtccagtttcgggttcggtggcgccaacgcgcacctggtggtgcgcgaggtgctgccccgcgacgtcatcgagcgcgagccggaaccaacgcccgccccgcaggccgccgccgagcccaccgaattgcctgagccgcaggcccacgcgctgcggttcgacgacttcggcaacgtcatccccgaccccgaagcgcccgaggaggaagagcacgagcttcccgggttgaccgaggaggcgctgcgcctcaaggcgatcgcgctggaagagcttgcggcgcaacaggagtccgagcccaccaagccgctgatcccgctggccgtgtcggcgtttctgacgtcacgcaaaaaggcggccgccgccgagctggcggactggatggaaagcccgtaggggcaagcgtcgtcgctggaatcgatcggccgcgccctgtcccggcgcaaccacggccgctcccgcgcggtggtgctggcccacgaccacgaggaggccatcaagggtctgcgggcggtcgccgagggcaagcagcggccgaacgtgttcagcaccgacggcccggtcaccaacggcccggtgtgggcgatggccggtttcggtgcgcagcaccgcaagatgggcaagaacctgtacctgcgcaacgaggtcttcgccgagtggatcgagaaggtcgacgcgctgatccaggacgagcgcggttactcggtgctcgaactgatcctcgacgactcgcacgagtacggcatcgagacctccaacgtcgtcatcttcgcgatccagatcgcgctgggtgagctgctccgccaccacggcgccaaacccgctgcggtggttggccaatcgctcggcgagccggcgtcggcgtatttctccggcgggctctcgctggccgacgccacccgggtgatctgctcacgctcgcacctgatgggcgagggcgaggcgatgctgttcggcgagtacatccggttcatggcccttgtcgagtactccgccgacgaactcaagacggtgttcgccgacttccccggcctggaggtgtgcgtgtacgccgcgcccagccagaccgtcatcggcgggccgccggagcagatcgacgcgatcgtcgcccgcgccgaggccgaggggcgtttcgcgcgcaagctgcagaccaagggcgcggggcacacctcgcagatggacccgctgctcggcgagttctccgcggaattgcagggcatcaagccgatgagcccgaccgtcgggatcttctcgacggtgcacgagggcacctacatcaagcccggcagcgagccggtccacgacgtcgcctactgggtcaaggggatgcggcattccgtctacttcacccacggcatccgcaacgccgtcgacagcggccacaccacgttcctggagctcgcccccaacccggtggcgctgatgcagatcggcctgaccaccgccgccgcgggattgcatgacgcccaactgattccgacgctcgccaaaaaacaggacgacgtcgagtcgatgatctcggccatggcccagctctacgtctacggccacgacctggacattcgcacgttgttcacccgggcgaagggtccgcaggattacgcgaacatcccgccgacccggttcaagcgcaaagagcactggctcgacgtgcacttctccggcgacggttcggtgatcatgccgggcacccacgttgcgctgccggacggccggcacgtgtgggaatacgcgccgcgcaacggcgagacggacctggcggcgttggtgagatcggctgccacacaagtgcttccggacgcgcagctggtggcctccgagcagcgggcggtgcccggcccgggagcccggctggtgacgaccatgacccgtcatccgggtggggcgtcggtccaggtgcatgcccgcatcgacgagtccttcaccctggtctacgacgcgctggtgtcgcgggccggccagaacgtggcggcgctgccgaccgcggtcggcgccggcgcggccatcgccgccgccccgaccgtcgcggcgcccgagcagccggcgcaggcccccgtcgaggaggacaccaacgccgagacgctgtcggacagcctgaccgcccgctacctgcccgccggcaccggcaagtggtcaccggattcgggcgagaccgtcgccgagcggctgggcctgatcgtctcggcggcaatgggttacgagcccgaggacctgccgtgggaggtgccgctgatcgagctgggcctggactcgctgatggcggtgcggatcaagaaccgagtcgaatacgacttcgacctgccgccgatccagctgaccgcggtgcgtgacgccaacctctacaacatcgagcagctgatcacgtacgcgatcgagcaccgcgacgaggtcgaggcgctgcacgagcatcagaagacgctgacgcccgaggagatcgccaaggaacaggcccagctgctcagcggggcgacgccggcctcggtcgccgcgcccgcccccgacccgcaggccgagcccgagacccagccggccccgccgccgccgtcggacaccccgattccgccgccgccgacggacccgtcgggtccctccgccaacggcgggcagcccaagccgagcctggccgaggcgctcagctccgaagcggtgaccaaggcgctgaactccgacgtgcccccgcgcgacgccgccgagcgggtcaccttcgccacctgggcgatcgtcaccggcaagtcggcgggcggcatcttcaacccgctgcccaagctggacgccgacaccgccgccaagatggcgcagcggctgtcggagcgggccgacgggccgatcaccgtcgaggacgtgcaggccgccgagaccatcgaggcgctcgccgagcgggtgcgcacctacctggaggccggccagatcgacgggttcgtgcgcaccctgcgggcccggccggagggcagcaccaagatcccggtgttcgtgttccacccggccggcggttccaccgtggtgtacgagccgctgctcaagcggttgccgccggacaccccgatgtacggcttcgagcgcgtggaggggtccgtgcaggagcgggccgcccagtacgtgcccaagctgctggagctcaacggggacaacccgttcgtcctggtgggctggtcgctcggcggcgcgctggcctacgcctgcgcgatcgggctgaagcgggccggcgccgacgtccgtttcgtcgggctgatcgacaccgtccgggccggcgaggagatcccgcagaccaaggaggagacccgcaagcgctgggaccgctacgcgcggttcgccgagcgcaccttcaacgtcgagatcccggcaatcccctacgagcagctcgaggagctcgacgacgaagggcaggtcaagttcgtgctggacatcgtccagcagagcggggtgcagatcccgggcggcatcgtcgagcaccagcggacgtcctacctggacaaccgggcgctcgagaccgtccagatcgagccgtacgacgggcacgtgacgctgtacatggccgaccgctaccacgacgacgtcatcgagttcgagccgcgctacgccatccgccagcccgacggcggctggggcgagtacgtggccgacctggaagtggttccgatcggcggcgagcacatccaggtcatcgacgaaccgatcatcggcaaggtcggcgcccacctcaccgacgtgctgaataaggtggaggcgcaaaccagtcagacaagtgaggtaggcaagtagtgacggagatggcgccggcccccatccagcacaccaccgccgagaagctggccgagctgtacctccggctggagttggccaaggagcccggaggcgagaaggccgccgccaagcgggacaagaagggcatccccagcgcccgggcccgcatccacgcgctcgtcgatccgggcaccttcctggagaccggggcgctggccaagacacccaacgaccccaacgccctctacggcgacggctgcgtcaccggccacgccatgatcgacggccggccggtcggggtgttctcccacgaccagacggtgttccagggcacggtcggcgagatgttcggccgcaaggtggcccggctgatggagtggtgcgccatggtcggctgcccgatcatcggcatccaagactccggcggcgcccgcatccaggacgcggtcacctcgctggcctggtacgccgagctgggccgccggcacgaggcattgagcgggctggtgccgcagatctcgctgatcttcggcaaatgcgctgggggagcggtgtattcgccgatccaggacgacctgctggtctcggtgcgcgatcagggctacttcttcgtcaccggcccggacgtgatccgggaggtcaccggcgaggaggtcaccctcgacgagctcggcggctccgacgcgcaggcccgctacggcaacatccaccacgtggtcaacaccgaggccgaggcgttccagtacgtgcgggagtacctgtccttcctgccgtccaactgcttcgaccagccgccgatcgtcaaccccgggctggagcccgagatcacgccgaccgacctcgagctcgactcgatcgtgccggactcggacaacatgtcctacgacatgcacgagatcctgctgcggatcttcgacgacggcgacttcctcgaggtggccgcccagcacggcccggccatcattaccggctacgcccgcgtcgacggccaccccgtgggcgtgatcgccaaccagcccatgcacctgtccgggtcgatcgacaacgaggcctcggacaaggccgcgcggttcatccggttctgcgacgcgttcaacatcccgctggtcttcgtggtggacacgcccggctttctgcccggggccgaggaggagaagcggggcatcatcaagcgcggcggccggttcctctactcggtggtggaggccgacgtgccgaaggtgacgatcaccgtccgcaagtcctacggcggcgcctacgccgtgatgggctcgcggcagctgaccgccgacttcaacttcgcctggccgaccgcgcggatcgcggtgatcggcgccgagggggcggcgcagctgctgatgaagcggttccccgacccgaccacgcccgaggcgcagcagatcaagaaggacttcatcgagggctacaacctcaacatggcgatcccgtggacggcggccgaacgcggcttcatcgacgcggtcatcgacccgcatgagacgcggctgctgctgcgcaagtcgctgaagttgttgcgggacaagcagttgtggttccgcgtcgcccgcaagcacgggctgatcccggtctagtcgcccacggcctgcttggtcgcctgcacgaaataaccgcgcggcgcccccgcgacgtccatcgggaccgcgggcgcataccagcgctggtaccggttgcccggttccgcgacatcggtgaccgtcgccgaccagccgaggcgctcgcacaacccgcccgggtcgtcggtgccgaagcgccacggggcgccgctgcgggccatcgactccagcaccggcgccatgaactccgactccagcagcgccttgccgacgacgtcgtagagcaggaccgagccgcgcgccgagagcgcgtcgacgcggtcgaacaacgcggtgaccgcggcctcgtcgaggtactgcagcagtccctcgatcagccacaccgccggcgcggacggatcgagtcccgcgcggcgcagggcggccggccagtcctgggccagatcgacccccaccgcgacacgtcgacacgccggccgttcgccggccagcacgccgtccttggccgccagcacctccggttggtccagttcgtagacgaccgtgccgtcgggccacgctagccggtaggcgcgggcatccatgccggcggccaggatgacgacctggctgatttgctgcgccgcctccagcagggcgtcatcccagaaccgggtgcgcacgacgatctgcgcggtggcgctctcgccggtcgcggccagcgccccggcgagcagctcgcgcccccgatcgccggccagccgtgccgcgaacggatcggcgaaaagccggtcgtcgcgggtggtttcgtgggcgcggatggcggccaccagcagcgcggtgtcggcgaccgcggcgaggtttgcgtccatcaccccatcatcggcgccgggcgcgggccgcggcttggatattttggccgcgtgcactcaccgggcgagttcgacgtgaccgggcatcgacgaacgtcgccgcgcgtactgcgtgggggtgacgccggtgaaggcgcggaactcgcgcaggaagtgggcctgatcgaaatagccgaggtcggccgcgatcgtcgcgccccgcgccggggtgtcgagcgcgcgcagcgccgcctgcagccggcgcacccgaagataggccttcggtgacaggccgacctcgcagcggaacagcgcggcgaaccgcttacgcgaaagaccgctcagctcttgggctttcgagacacgcatggacgggtcgagatccgcgccgcgcaacaccggcgccaggcgcgcaggcggccacacggcgttgcggcgcatccggcggaccagaaacgcctgcagcagcgccacgcggcgcggtggcgagccggcgtcgatgagttgctcgcgcagcagcgccgcgtcccggccccagagctcttcgaggccaaccagcgcatcctccagatcgctcagcgggcaacccaggaatgccagcgccccggcgggccggaagtggatggtcatcacggtgtgggcgggggcgacccgcacgacataggccgtcgcgcccgccccggcggcgaagaggggcgggaccgtcagcggcgtgcgggcatccgaggcgtagaagccaaggtcggtgcggccggcgacgtcgacgatcgcggtgaccgcgccgcgcggcagcgcccggctggtatgcacccccaaggcctcgtcgccgcgccagtaaccgaaatactcgatgtgctcggcgagcggcgggctcggccggtacaaccgcggagcagtcatggcgcggcctagggacggaacgcgccgtcgaccagttcgtcgaagcgctgcaacgcctcgtcggagtcggcgtcgatgccgcgcagcgcgccccggtcggcgaggtagcgctgcgcgtagagccgcgcgaccagcgccttgcggtcaccgccgcgggtggcccgctcccaggcggcctgctcgaccagcaacgcgccgccgtagacgtcgcccatgaattgggccagcgcgaacagccgcgcctcggccagcggcttgtcgagcttgccccaggcggtgatcgccgcgtccaggtcctcgatccggccggccaccaggcgggtggcttcgtcgtcgtcggccaccgacaccgcatcgcgcagccgggccagcagcgtctcgtgcgcccgggtctgctcgatgccgcgccgcacatccaggcacaggatgttgtccgggccctcccagatggtgttgacctgggcgtcccgcaaaagccttgccaccggccagttttcgatgtagccgttgccgccgtggatctcgatcgcatccgaggccgcggtgatgcccagccggcacacccggagcttggtgaccggcaccgcgatgcgctggcgcatgccgcgcggctggcgatggttggtggcgccggtgccgtcgaacaccatcgcctgcgccgcctcgacgtcgacgatcagctcggcgagcttgcgccgcatcagcggcttgtcgatcagcgcgccgccgaacgcccggcgctgccgcgcgtaacacagcgactcgaccagggcgcggcgcgcgttgccgagcccgaacaacgcgatgcccagccgcgcggcgttggtcagctccatcatccggcccagccccttgccgtccgacgcggcgccgtcggtgggctcaccggacagcaggaacgcctcggcgtcgacgaactcgacctcgccggaggccaccgagcgggtgccgagcttgtccttcagccggcgcacccgcaccccgttgcgggaaccgtcgcggcgggtgcgcagcaccaggaagttggccacaccacgcgaattgtccggtgccccttcgggtttggccagtacgacgaacgcctccccggcgcagttggaggcgaaccacttgaagccgttgagcagccagctgtcgccgtggcgcgtcgcggtggtctccaacgcgcccaggtcggagccgccggtgcgctcggtgagcagttgcgcggtctcaccggcccactccccggaggcgaacttggccagcacgtgctcgcgcacatcggcgggcgcgtaggcggccaccagcgactgcaccatgccgccgccggtgcccaacgcacaccccatcccgatatcggcttggttgagcaggtaattcgaggcgaacagcggcagcgacgagctcatcttcgccgcccgcgcttcggtgcgcagcgcctgctgggcctccagcacggcccgcttggactggacgaaggacggcggcatcaccacccggctgatgtcgtggccccaccggtcgtagcgctccagccggggcgggttgcggtcggtctcctcggcccagcgcgccaccgggccgcccatcagctcaccgatgcgcgacagatgccgctcggccagcgccagctcgtcgggccgcaggtagtaggacatggtgaactgcagcgtcggatcggtgtcataccagttcagacccacggccccgcagtagttctcggtcgcgtagcgctgggatttcgccgcggtggaaaagggcagccgatccaccgcctcgacggcgtagtcgctcatcgttgagacgttacgcgcccaccggcacccgggtgcggattgatcagccgcccatgggccaccagcgatccgtgttgcttgagccgctgggtgcggacgttgacctcgtagccgagcaccccgtcgagctggccgagttgctcgcgcaggtagcggtacaggtcgtcggaatctcggcagatggccacggccatcaggtttttggatccgcttgtggcgccggcgaaagcaatctgcggatgggccgcgatacgttcgccgaccgtgtgcacgtcgcgaggcgcaaccgtgagccacagcatggcgctgaggcgatggccgagccgttcgggtagtacgtcgacgtcgtagaccagggcgccgcaggcctccagcgccgcgatccgcctgctcacccgcgccaccgaccaaccggtgcgcgcggccagttgggactgcggagtgcggccgtcgtcggcgagcgccgcgagcagcgggcggtcttcggcggtgggccgggaccggtgagttcccgactccggctgggcccgcgcggccacgatccgctgcgcttgccggtccgagagcgcgctgccgtagcccgtccagggcgcgttcaccgggtcgccgaacgaatgcagcatcagatcgatgctgatgtcggtgaccgcggcggtgcgcggtaggagctgcgtcagcaggtcctcgcgggtgtcgcccagcggcgcacggatgacgcagaccaggtcggtccaccccgccagcacattggcgtgggacacgtcggggcgtcgcaccagcgcgtcggccagccgcgatatgcggtccggcgccgcacggatgcggcacacccagtccgcgtcgccatcggcccaccggttctccagcccgacgacgcgcaccaccccgtcgcggcgcagccggtgataccgccgggcgaccgtctgctcggtggcgcccaccacgctggcgatccggcgaaacgagacccggggagctaactgcagggcgtgcagaatctgtgcgtctaactcgtcggtcatcaggaaaagtatccgcgtggacaggtccaagtgaggatttcaggccaatttggtcgcggcgagcgcaatttcaacgcctccgctgtcagcctggaagctcggcctaaggagcgctcacatgcacatcgaaatcggactgcccagccatatcgcccacgtgcgggggcggctgaccgtcgagtgggcccgccgggccgaacaccgcggctttgccggcctggccgcgatcgaccggctggtgtacccgagcctcgacgcgatgaccgcgctcgcggtggccgcgggcgcgaccaccggcatcgggttgacgttcaacgtgctgctcgctccgctgtaccccgcggtgctgctggccaagcaggtcatcaccctcgcggaggcgtccggcggccggctgcgcctggggctgggcgtcgggagccgctgcgacgactacaccgccgtcggcgtcgactatcggcggcgcgggcgcattctcgacgagacggcggcgctgctgcgtgccgcgtgtgaggccgaggtggtgaccggcgaccagccgctgtgcccggcgccggtgcggatcccgatcctgttcggtggacgggcggacgcgacgatccgccgcgccgtgaccgtcggtgacggctggaccgccggggcgctgcgcgattacgccaaccagtcggtgttcgccgagcgggtccgggcggcatgggcggcgcggggccgctccggacggccgtggctgcaggccagcgtcaacttcgccttcggcgatgacgaggccgtcgccgctggccgcagacacctgcagagctactacggcttcaagcccgactacgccgccctcaacgtcgccgacatgctcaccacgccgcaggaggcggcgcagaccgtgcgcgcctacgccgacctgggcttcgaccgcctcgtgtttcacccctgcgtccccgacaccggacaggtcgaccggctggccaacgcggtgctcggttaggcgcccaccggcaccacgaactccgacgtgtagaactcggccggattctgcgagttcggattcggccgctcgatgatcaaccacaccccggtggtgccgggccggacggtgtcggaaacggtcgccgtgccgcggcccgcgccgtcgaggtccataccggtgaaagcggttcccgggtcgccgggcccgcagccggccgacgacggccgcggttcttcgatgaggccgacgtcgaaatgcattccgggctcgggcgcgtccaccaaatgcacctcggccacggccgtggacccattgacgcggacgacggccgagccggtgcccagcatcgggctgggcaccttgggcgcgatgctcaccttgctgaaatcgcaacggcgcaagtagttgtcgaaaacgacggtggtgccgccaacctcggcggccgcggtggccggggatgacaccgcggccgggaggatcagcgccgtgatggcggccgcgtgggttcccaggcgaatcagcgtgtgcatcgggccatccttttccgggtgtgaactgaatcacggcggaattagtattgacccggaaatggattgccgaaacccattatcggtaattactcaatcgttaattcggcgcgttattcgaccggtgaataattacggctaaaccatttatggttttattcgtatcgggcccggcgaccaccaaccggtgcgggtcgcggtgcccaggtcgagttgcgcgggatgcgcgtcggcgatggtttcgaaccggcgcagcgatccccagtcccggccccagtcgtgcgacaggtacgtcgacatcacgtgcgcccgcagcagcaggtcggtgatccccagcaggcccccgttggtgccgtcctcccaggtgtcggtgtccatcttcttggccgtgtaatccggggtgatgcggaacttggggatctcggtgaccccgttgacgtgcagcatcggctgctggcacgggaaggccagccccaccgcccagtccatcagcaccggctgggtcgagccgacgtactcctgcagcgagcgcatctcgggcacccgcggcggggtcaccgcgatccagtcctccggcgtcagcgacaggtcctcggccaccacccgcacggccacggtgtccgcgggcatgtcggagcgggcgaagcgcaggttgcgccaggccttgggctgctcgccgtacaggtcgtagggcaccagccggccggcgggcacgatgtcaccgccgggcccgggcctgccgtactcgagcaccacggtctgcccgtcggtgtggtggtgcagcacgctgttgccggcgatcttgccggcggcggtcaccaccaccagcgggtgaccgtcatcgggtgcgggcagccggtaccacgccgaggtcagccggctctgctgttgcgccccggtggtgtagctgccggccagcggcacccgggcggcgtccaggccgtacggcagcggcacggtcgagccgttgatgcccggcgcgctcagcttggtcggcgcgtcccagtcgtagtcggtgccgggctggttgggggtgatccgaatcgcttcggcgacagtgtgttcgggcaccccgttcggggagaagcccaccgggtgctgcccgcccagcgggcccagcggcccgtaatcgccgccgagcggcgtcatgtagccgacgttgctgtccggttcgacgagcacgtcgtcggccagcccgcagccgccgctgaactcgcgcaggttgtcccaggcgttggagtaggtggggtactggcggacgatgccggccaccatcgacgcgatgaacaccagcgccatgaagccggccgcgaggggcaccggcgcggccgtcagcgcccgggccagccggccgtcgccgtgctcccgggaggcgaagtgcaacccgatcgcgtacagcgcggccgcgacgaacatcgcgaaaaagactgtgctgaccgtgattccgccgatcttcggcatggtgctgttgaacggcaccccgtagctggacacataccaccagccgttggtggtggcgaagcacagcgccatcatgaacagcagcgcggccaagaacgccatccggttgcgcgaccagcgcagcaccgccggcgacaccagcacggtggtcagcgcggccatcgccgcgcccaccgcggcgaacagaccgaagtggtgcacccacttggtgggggtgaacatcaaaaagaacatggtgccgaagatgacacccatcagccgccacgccggcccgcgggccaccccgggaattcgcttgcgccgcaacatgatgaacaccgcggtgaacaggcacagcgcggtgatcaggaagccgaaccgccgggacagcgagccgtcgacggtgggcaggatcaggtagtagtagcgcaggttctcggtgtaccaggcctggctgggtccgatcgcggtgcgaatcctggtggcttccaacaccgttgccagcgtctggtcggcgaacaccaccgtcaggatcaccgtgccggcggccagcatgggcgccaccagcggccaggtgcccaccacccggtgccggcggaccaggatgcgcaggatcgggcgaccaccggcgaccaacgcggccaccgcgatcaggccggtgggctgcacgcccagcgtgaaggcggccgtgatgacggccagcgcggccggggtgagccggctgtagcgcatcgaacgttcgatcagcacataggtgaccagcgatcccagcgcgatgatcggctcggggcgcagcccgttgtcgaacggcatccacgccgtcagcaacaccatgcccgccgcccggttggccggcctgctggcggccaccgccggccccagccggggcagcacttcgcgggacagcaacagccagcacacgattccggcgaacaggtccggcaaccgcatccacaggctggcgtcgctgacatgcgtcatcagcgccagcaggttgtagtaccagccgaacgggtcctcggggctgccgaaccagcggaagtagttcgacatgtagccggcgcggtcggccacccgggccatgcccaggatgtagccgtcgtccgacgagttcgccccgatcacgtgccagagcacgaacccgaagatcaccgcgacgtcggccagggtgaacgtgcgccagttcgccggaatgagccggcgcatccggtgcccgtccagctggtcgagccgccacagcgcgaccagcgcgacgatggtggccaggatcgccgtcaccatcgccgccagcttcaaagtggttggcgtggtggagaatcgggtgtcgatggtcgccgacagcttcaggccggccggggagggcccggtcaggtcggtgaacacgccgacgatctggggccgcaggttggggtcggggaatccgccgccgagtggtttgcccgccgggtcggtgagcccgacgaaggtggcgaaggtgccggcgcgggtcgaggtgatctcgatgcgggaacacccggctccggccacctgatcccgggatgcgctggcgatcaccacgttgcggtcggtgacgtcgacgcgcttgccgtgggcgacgacgaacaacgcgttgagcgcggcgtccttgcccttcttgggcccggtggacaggatcaccccgccctcgggcggcaggtcgcgcaccgacgagcagggcaccgtcgcggtcaggtccaccggggtgagcgaaatcagcggtgcggtaacgctgttcaactgaccgccctgcggccagttcagagtcgcggtggtctgcacgacgggcagcagcggggtggcgaccgacagcacgaacccgatcagcccggcgatggtcgccacccagcgcgtcacccgcacgtcgccgccgacggtcgaaacgctcatgggagtgcccgaatcggtccctgccggctccagccgtgcactgtcatcacaccctgttcgatagcggcgtccggcgcctgatcggccggcaccaaccggaagtactgctccaccgatccccagtcgcgataccagtcgccgcgcagataggtcgggatggtcgaggtgcgcagcagcgcctgcaggaacaggaacggcccgccggcttcgctggactgccacaggttcgacgacgccgcggtctgcttgcggtccggcaggatgcggtaggccggaagttcagccacgccaaggtgttcggagaagggccgctggcacgggaagttcgccgcggtcgcgatgtccatcatcaccggcgtctgcgagccgatcagctgctgcagggtttcggtcaccggcacccgcggcggggtgaacgcgaaccactgctcggaactcaggttcgggtcgtaggcgacgatgcgcgccacgttggcctccggcggcgcccaggccagcgggaagcgcagattgcgccacgccggctgcgggccgatgtcgatcggctgcacctcggccagcggcaccgtgctgccgtccgggcgggcgacgccccactgcagtttcagcgactggccgtaggtgaacgtgccgtcctccttgtaggaccagatcgcgccggccgccgacaccaccaccagcgggcggtccggcgtgcggggcggcagctggtaccaggccgaggtggccgtggcggccagcgagttctcgccgtagctgcccatcaccggggtgcgggccgggtcgaggccgaacggcagcgccgcgtgcgagccgttgacgcccaccggccctttgccgccggcggtgcccgccgagtcgctgtaggcgacgttgggtttgttgggggaggcgtccgagttgaccagcccgggcttggtcaccacggggtcggactgcaggtcgtcgcccacgccgtcgggtttgaagccgaccgggttgaccccgccgagcggcccgtccggcccgaacgtctggcccggcagcggctgcagcatgccggcgttggcgtccggctcggccagcacgtcgtcggccatcgcgcagctggtcggcgacagccccgacgcgatggcggccaggttggccttgccggtggtgtacagcgggtagcggaacaccgcgcccttggtcagcgaggcgacctcgccgaccaccatgatggtcgcgaccaccagcagcggggtggacgccagcacgcggttgcgccggctgtccttgacctcggtgtggcccgcgtagtccatccggaagtgctgccaggccgccagcagcccggtgatgatggacagcgtcaggaacatcgacgtcaccgggtggctggcgatgaccggctggatgtcgtaccacggcaccccgtagttgccgacgtagaaccagccgttgatcccggaggtggcccaggccagcacgaacagcaacgccgtcacgtacagcgtgagattgcggcggttgtgcaggccgatccgcgagcaggcgaacgcggtcagcgcgcccagcgccccggccagcccggcgaaggcgccgaactggaccgcccacttggtcggcgtgaacgtcaacagcagcagtccgacggcggtggtgccgatcagccgccaggccgggccgctggccaccccggggacatggccgcggcgcagcaggatgaccagcatgccgaacaggcacagcagcatcaccagcacggcgaagcgccgcgccatcgacccgtcggggttggattcgaccgtcaggaagtagtagcgcaaccaatcctggtaccaggcgatcgtcgggccgaccttgtatttgatccgggccgactccagcaccgtggccacggtctggctgcggaacaccaccaccaggatcagcgacagcgccgccgccagcaccgccagcggcgccagcagaccgtcgctggcccggcgccgccgcatggtctgggcgacggcccgggcgccggtgagcagcgcggcgaccgcgatgaggccctgcggcgccagggtggcggtcagcaacgccaccacgacggccaccgccgccggcgccagccgctgcagcgcgatggcccgttccaccagcatccaggtgaccagcacgcccagcgcgatcagcggttcgggccgcagcccgttgttgaacggcagccaggccgcgacgaacaccgcgcccgcggtgaagaccgccacccggttggccgccagcccgccccggcccgggcccagccggcgcagcacccagtggctgatgatcagccagcagccgatcccggccagcgtcgcgggcagccgcatccacacgccggccgtgctcaccgaggccagccgggacagcaggcccagataccagtcgaagggcgcgtcggtggtgccgaagtagcggtagtagtcgacgaggtagccggccttcggcgcaacccgggcgatggtcaggttgtagccgtcgtccgacgaggtcgccccgacgacgtgccacagcagcagggtggcgagcaccgcggcgtcggcgatccaggtcgcgagcccgacccggcgccagttggccaggtgggtgccggggcggtaccgggacagccacgcgatcggggagcgccagttgatcagggtgccgccgccgcggctgtgccggtccagcaccgccagcgcgacgatggcggtcagcaccgccagcgtgcccagcaccatcacgatctgtttgaggaccgtcggcgcggtgatgaaccgggtgtcgatgtcgacgcgggccgaaagccccggcccggcgggcaccttgaggtcggtgaagatcccgccgacctggggcttcttctcggcgggcagggttcccgcggcgccggggatgccgacgaactcggcaccggccgcgccggcgtcggcccaggcgtgcagcacgctgcaggccccggcggcgacggccgggcgctgcgccaccgccgcgacggtgtcccggaaggcgacgacgaccacgtccttgttggcccgcacgaacagcccgttcttgccggcgtccatgccgccgggcggcagcgtggagaccaccaggccgccgtcggcgggcagggtggcgacggccgggcaggggatggagatgtccagcgcgcggggcgcccccgacaccagaggcgcggtgatctggctgacgtgtccgtcgaccgtgccctgcggccacagcacggtggccgtggtctggcgcaccgggagcagcgggacggccaggcacagcagcaggccggcgatgcccgcgacggcggccaccgaccgggggatccgctgcgatcgctgtttaccgtcgtggggcacgaggctcgatcgtaagcgacgcggctttgtccgcccgggatgcggggctgcgcgggggcgatctccgccgcgcgccggtgcgaacccgggggtgattcacagcgaacatccgcccgccaattcagcattcgccgcgtgcgtgcggtcaaaatggactgctgaggaggctgacagcgcgtggcgaacgcaggtctggggttcggtgtcctgggtccgttgtcggtgaccgccggcggcgcccagctgccgttgggtgcgcccaaacagcgggcggtgctggccatgctgctgatccaccgcaaccggccggtgtccgtcgacgcgttgatcgacggggtgtggggcgcggcgccggtgccggcggcgcgcaccagcatccagtcctatgtgtccaccctgcgccggctgctgcgcagcgcgttgcccaaccccaacgggttgctggccagtgtcccgcccggctaccagctcaacgtcgccgacgcggactgcgacctgggacgcttccgcgggcacaagaccgcgggggtgcaggccgccagccggggacgcttcgaggaggccagcggccacctggcggcggcgctgcgcgaatggcgcggaccggtgctcgacgacctccacaacttcgcgttcgtcgacgcgttcgccaacctgctgctcgaggagcgcgtcgcggcgcacaccgcccgcgccgaggccgagatcgcctgcgggcgcgccgatggcgtcatcggggagctcgaggcgctggtcgcccagcatccctaccgcgaaccgctgtgggcgcaactgatcaccgcctactacgtcaccgaacgccaatccgatgcgctcggcgcctaccggcggctcaagaccgcgctggccgaggggctgggcatcgacccggggcccaccgtcaaggcgctgcagcagcgcatcctgcgccaggagccgctcgggcccgggcagcccgggaaggccgccaggcgggcgatgctgagcacccacaagcagagcacggtgcggtccgagtcggcggcggcggtgatcgacaatcccgtcgtcgcccggttgcgggacaaggccgggcgccactatcagctcaacggggtgaccacccggatcggccggctcgacgacaacgagatcgtgctggacgacaccgaggtcagccgccaccacgccgtcatcatcgacaccggaacggatttcctgatcaccgacatgaaatcgaccaacggcgtccaggtgcggggccggcgggtgcagcgcagcgccaccctggtcgacggcgaccacatctgcatcggcaactccgagttcgtcttcgaaatccggcccgcctgaacgctattggccgagccgggcggccagcgtggcgcgccccggcccgtccagatcggccagcgcggccgggcgccccgacatcgccatcagcagcgcctcgccgggcccgctcacctgcggcccgtcgccgtgcgtccagtcgatgtcggtggcgcgcagtcgcaggccccggatccgtcgccccgcaccgagcctgggattgccgggcaccagcgacagcacccgctgcagccggtccggcggcaccacccgcggccggcccagcgcgcggcggatgtcctggtgatgaatcgtcccgtcgaccaatgcgatcattccgccgaaacccgctgtcaatccccgcggttcgaggtgctcgcgcaggaactccagcagctgttgcggcgtcaggtccgcgaactcgtcgacgcccacctggttggcccgcaccacccagcccttggcgaagcgtttcagcaacccgaaagcccccagctcttcatagctgatcacatgggcgacaacgtctttcacgctccaccggctgcacaggctgggcgcctcccaatcccgcggccccagggtggccaggaattcggcgaggtcggcccgctcggcgcgggccatcgccatcagctcggaggtcatcgcggtcggccggtgctcacaaacgccaaacctaggccgacggccgcccggtctcaagggcgctaccggggacgcaaggatttcccaagaatctctcgaccgtccggcaagccggccgtcgcaacctggtgttgccggtcggcgcgaccggccctagagaaatacggcagataggaatcaccatgaaggagaaggtctccaagctccgcatcgccgcgggtgtcgggttgggcgccatcggcttgtccatcgccggttcgctgatgccggccgtcgcctcggcgagcccgtacgtcccgcacagcggaccgctgcacccggtgcgtcactacgccgccaacttcttgaacccgggctgggcgctcacccacccgctgcgggcctcggttccgtgatctgaaatcgctgacgctgccccgccttcggctgtcgccggaggcggggcagcgttcgtcagtgccgcagcggcgccgggttccacagcccgctgcgcgtcgccgtgcccagcagcagctgggcgggccgggcgtcgggatagtacggggtcagccgttgcagcgagccccagtcgcgggaccagtcgtccttcaagtaggtggccatggtggtggccttggccagcagctcggtgacgcccagcgggccgccgccgttgttgtccatcaccggcgagttggcctcggcgccgaatcggtccggcaggatgcgccatttcggcgtctcgtccacgccgttctgatggccgaacggccgctggcaggggaaggccagcccgaccagccagtccaggaacaccgggtccttcgatcccaccacgtcctgcagggtgcgcagctggggaatacgcggcggcgtcagcgcaatccaatgctgcggggccaggtcttcgtcgtcggcgaccaaccggacctgggtggcggcggccgggatcgccgacagcggcaaccgcaggttgcgccaggccggtgacgcgccgacgtcggcgaattggaacgagccgcccgggtgcccaccggccgcctgctcgtcggtggcccactgcacctggacctcgcgcgggtcgaagcgcccggccgcgctgaccaccagcagcggccgcgccttgtcgcgggcgggcagccggtaccagccggaccgcaggtgggcgggcacctggatgccggagcgccagctgcccagcaccggggtgcgcgccgggtcgaggttgaacggcagctgggccgacgacccgttgatccccggcgccggggtggtgccgccctcggtgccggcctggttgctgccggttttctcctcgtcgttgacgaagctgcggtcacccgggcgttccatcaccgggtcggcgcgcacgtcggcgggaatcccgttggcggtgaaggcttccgacaaccccgcgcccagcgcgtcggctgccgacgggccggccgggccgccgaccggcgacagcaggccggcgctggggtcctgttccaccagcacgtcctcggccaggccgcacgtcttcccggtcaacgcctgcaaattggagcggccgaccgaccacgccggatactggtccgtcatcgccaaggtcagcgacgccacctcgaacaccaccagcgcccaggtcgcaattgccaagggggactggatgattccggccagccgcgccccccagcgggttttcggcgggccgtcgtcgggcgccacgaaatggaaccaggccgccagcagcagcaccagcacggtcagtccgagcagcgcggtggcgaacgcgtaatgccacgccgggaacgcattcgaccacggcacaccgaaattcgagacgtaccaccagccgttgacgctggcgaacgacagcgccaccaaaaacagcaccacggcggcgtagacggtgcggttgcgccgggaccgcatcgccgccgcggtcaccgcgaccgcggccagcgcacccagcggcccggccagcccggcgaacaccccgaagtggtgcgtccatttggtgggggtgaacatcatcgcgacgaacgagatgatggtgatcccgacgatgcgccggctcggcccggtggcggtgccgggaattcggcccttgcgcaacgacattgcgacggtcactccgagcgcgagcaccagcgccagcacggcgaagcggcgggcgaccgacccgtccgggctggccatgaacagccgctcgtagcggatgtgttcgtcgaaccagctcaggctgggcccgacggcgcgcttgagcatgctggcctgaacctccccggccagcgtctggtcgcggaagatcaggatggcggtgacggtggccgcggccagcaggggcgcgatcagcgggagcgcgccgaatcgcgtgatccggcggtgcaggatcgtgcgcagcggcccgatcgcgaccagcagcgcgccgatcgaggcgatgcccgtcggcccggagaacagggtcagcgcgccgatgatgcaggcgaccgcgaccggcagcagccggctggtggccaccgcgcgttccaccgagcaccaggtcagcaggatgcccagggcgatgatcggctcgggccgcaggccgttgtccagtggcagccacaccgccaggaacatgcccgccgccgtccaggccgccgcccggttttgcttgacggcgtgacccagccgcggcatcacctcgcggctgatcacccaccagcaggtcaacgccatcgccagggtgggcagccgcatccagatgctggtggtgctgacgtgcgcccacagcgccagcaggtcgtagtaccagccgaacggcgcttcgggcgtgccgaaccagcggtagtagttggccatgtagccggcgtgctcggacacccgggccatggtcaggatgtagccgtcgtcggaggtgttggcgccgacgaaatgccaccacgtcagcacggcgatgaccagcgcgtccagcccgccgatcgaccaccagcgggcaggcaggaagcggcggtgccgggtgccgtcggcggtgtccaggatgtgcagcgcgaccagcgccgcgcccgtcagcaccaggccgaggatcatcgcggccatcttcagcggggtggggctgctgctgtagcgggtgtcgatggtcgccgagaagctcaggcccggcggcgccggtccgctcaggtcggtgaagacgccgacgatctgcggccggaagtcatagccgcttttctcgccgcgcagcggcacgccgggatgctcggtgttggggccctgggtgagcccgacgaactcggcggtgaccttgtcggcgtgcgcggtgaaggtcaaccgctggcaggctgggcccagcacctggctcagcggggccgtcaccaccgggacgttgcgcaccaccagcaccaggtcgtcgttggcccgcacgatcagcagcccgcggtcgaccgccttgggcgcctgcttgggcaccgtcgacaacaacaccgtcttgccggggttgccccggccggccagcccggcggcggcctggcacgggacggtgatgttcaaatcggtggccacgtaaccgatcagcggcgcctccacgctgccgaagctgccgttctggggccagttcagctgggcggtggtctggtcgaccggcaacagcggggtggccaccgccagcagcaccccgagcagcccggcgacagaggcaacccaccgagcgatccggtgatttgcctccgtgtcgtgcacggagctagatgctagttcttcggcgatgcgggacccggtgtcggtgctcatcagtcgttacgccgccggcttgcgaacggccagcacgaaggggccgacgcggtggaccgcgaatcgcgggctgtcgaacagcgcggcgcgcagctcgacggtgtagcgccgcacgttgggctggttggggtagacgtcctcggccagccgcagggtgtaggtgttgttcgcgccgtggcgcatcaaaaacaccgtcggcggcggccaggggcaggtgtccagggcgtgcagcaactcgtcggcggtcttgagcttggaccacttgtcgatctgcgcggcccgcaggtcgaactgcgcgagcgggttggcgtagtgcgaggtcagcccctggaatccccagtaggggtagaaggacaggaagctgtagtcggcggtcatcaccacggtctggtcgcggggccggccggtctcgcgggtgatgacgtcgtcgatgctggcgtagaacttctccgcgctgggcggccgccggtcgccgcgctgcccgtggccgtcggtgtcggtgtaggcgatggtcaggtccggccgcagcacgtcggggatgtcctggctgaacgcgatggccgcggccagcccgatcgcgccggccaccgggatgacggcgcggcttcggcgccgcagcgcgagcgcggcctccacgagcccgaacgccccggccgccaccagcagcacgctcagcgtcggctgcagccggaaggacagcagcgtggtgcgggccagtgtggtgagcatggacagcagcgaccacaggtagacggccagcacgccgatggccagggcgcccgcgcgcaccgatgcgcgggcgcgcagcaccagccatagcgtgcccgccatgcagacgacgccgagcagcgtgaactgcagcatcgggaaggtcagctcggcgccgtcggccggcaggtagtgctgggcgctgccggtgttgctgaccggattgcgggccgcgcgaaccaggaacggcagccaggtggtgcacccgatcgcgaccgcgatgccgacgatgacggctagccggcgcagcggctcgagcgccgcgcggatcccgtgccgccgccagcgcaggcccgccagccacagcgccatcagccccaccgcgaacgcggtgaacccgaacagcagcgtgtaccaggtggccgtgaagcccaggaacagtccggctccgacgacggcggcccagccgctccgcggcgtctcgcgtggggcgctcggcgtctcgcccgccgcgagcgacgtctcgcgtggggcgctcggcgtctcgcccgccgcgagcgtgaagttagtttcacgctcggcgccgaccgtgaagttagtttcacgctcggcgctcccgggcgccccgccagccgcacgctcggcggtctcgggtgccccgccagccgcgcccccgggccgtcccgccagcccggcactcacccgcgcgcaggcccgaccaggtgagcaccagcaccggcggcagcagcacggtgatcatcgccgagtacggctcgggtgaaccgtaggccagcgtcaccgccgccgtcgcggtggtgacgatcagcgcgtactcgaaccggaccatgcgccaccacagcaccagcgccaccgcgacggcgacggtgatcgaggtgatggcccacggcttgaacacctcccacgccggtgtcccggacagcgcggccgcgcgcccgccgatccagaaccagcccggcgggtagaacggcggcagcccgagataggtcatgtcgcgcagggcgggactgtcggccagccgcgtcagatactcggtgcggaactgctggtcgacggagatgccgaacaaatacagcttggtggcgcccagcggcatgccgagcgtcaccacggtgaacgcggacacgaacaccagcccacccagttgagcgagccgccggactcggccggtgaacgagtgccacacccagccgacggcgaccagaccggccaggcaaccgacctgcccggcggtggtcagcgcgtgcagttgattcgacgacgggaaggccggccactgcaccccggcgatggcggtcagcgacaccaccgcgacgacgacggcgaccagcacggccacggccatctggccgagggtggccagcgcgctacgcatgatcagatcggcagtttgcggaaaatggggcgcgggatgtgtcgcaacaccatcatcacgtaacggaatgctgctggcgcccaaaccaattccttaccttttgcggccgcggtcaccgctaggttggcgacgtactccttgtccaccgtcagcggcgcttccttgacgtgcgcgctcatccgggtccgcacctggccgggtcggatcaccagcacgcgaacgccgtactcgcgcaacgcctctcccaggcccaggtagaagccatccaagccggccttggtggacccgtagacgaagttggaccgccgcacccgctcgccggcggccgagctcatcgcgatgatctggccgaagccctggccgcgcatcttctcggcgagcaagacgcccactgaaaccgctgcggtgtaattgatttcggcagcctgcaccgccttacgctggtcctgccacagctcttcggcgtcgccgaggatgccgaaggcgacgatggccacgtcgacgtcaccgcccgcgaacgcctgctcgatcatcttgggatgggtgtcggtgtcggtggcttcgaagtcgatcacctccaccgatcgcgctccggcggccttcatctgctccaccgcggcgtcccgcccggggtcaccgggcatggcggccaagatgattcgcgcgtgcgcgttctgcaggtaacgctcgcagatggccagcccgatctcggaggtgccaccgagcagcaggatggtctgcggatttcccacggcgtccagcaccatctagagcagctccaaacgtcgggccatgtcggaggcgaacacccccgtcggatccaccttgcggcgcaccgcgatccactcgtcgatgcgcgggtacatggcgtggaaggtttcggcgttggtgcgcgagtccttggcggtgtacacccgcccgccgaattgcaggacccgcctgtcgagctcgttgaggaactcgttgaccccgggcttgttggggaagtccatcgcgacgttccagccggccatcgggaagctcagcggcgcgcggttgcccgggccgaaaagcttgaatacgttaagcgccgagtagtggccgcgggtctggatccagcggatgatggccttgaactcgtccatcgcgtccggcgggaccaggaactggtgttgcgcgaaaccccttgggccataagcattgttccagccgctgaccaggtcgagcatgtgatagaactgcgacaggttcatgatcttgccggtgtaggtgccgcccagccggtagtacacctcaccgatcgccatgaacgacagcttgttcatcgcgctgaccgggaacacgtcgggcaccgtcaacagctggggcgcatcgaatttcagcggattcttggccagcttcttgggcagctggtccagccgggccaggctgccccggctcaccgcggcccggccgagcttgggcggcgggctgatcaggtcgaaccaggcgctggagtaggtgtagtcggcttcgctgccgtccaggtgcacggcgacggtttcgtcgaggtccttggtggccaccccgtcagcgatgaagtacgccgtctcggtcggggtcatggcgatggtggcgcgcagcacgatcccggtcaggccgttgccgccgacggtggcccagaacagctcggcgtcggaagcgtccgggccgtcgggggtgatggtgcgcacggtgccgtcggccatcagcagctccatggagcgcacgtggttgccgaagctgccggcgctgtggtggttcttgccgtggatgtcgcaggcgatcgcgccgccgacggtgacctggcgggtgcccggcagcaccgggacccacagcccgaacggcagcgccgccttcatcagctggtccaggctgacgccggcgtcgacgtcgaccagccgggtgtcggcgctgatcgagtggatgcggttgagcccggtcatgtcgatcaccaggccgccgccgttttgggcgttgtcgccgtaggagcggcccagcccgcgcgcgatcacaccgcggctcttggaatgacccgaatcggcgacccgggcgacggccttggcgatcacctcggggtcgcgggttctgagcacctgggccaccgacggggcggtgcgcccgaagcccgtcagccgggcgggcgtgatgaggggatcggtgctcgacatcgtgaaagagggtaccgcttgcacaagaaggctcagcggatgcggaagatgacggcccgctgcacgacgaagttgatcaccgtcgcggtgccctgcgcgatcacgaaggcgacggggatcgcccagccccggtagtgcagaaacgccagccacagatggttgagcccgacctgcacggcgaaggtgacggcgtagagcgccatcaccgcgacgaaccgggcggtgctgggagccgcctggaaggtccaccgccggttgatcaggtaggcggtgatggtgccgacgatgaagctgatcgccttggccacgtcgacctgcacacccacgaccttgtagagcgtcgcgtacaggccgaagtcgacgatgccggccaggccgccggtgacgacgaaacgcatgacctgggtggtcagtttcaggttcgggctggcaaccatcgaggggagtctagggcagcttgaccgcgatcagctcgacctgtttctcgccctgcggcgtcggataggtcaccgtgtcgccgggttggcgtccggcaagggcctgagccagcgggctgcgggcggtcaacgtctcgccctcgcggccgaccggtgtctcttcgacgatggagatcacgtgcatggtgaccacttcgccgtcggcgaaccgtaaggtcacctcggtgccgccgggcagcgtcgccgaggcgtcggagtccggcggcccggcccgcagccgccggtccagctcgttgatccggtcggacagcaccaccagctcgtcggcccgctggatcgcctcggccgcatcgccgtgatcgcccaccatcccgcggtcgttcttgacctcgacctcgaggcggtcgcgacgctgccgcagccggtccagctcggcttccaggtttttgcgcgccgcgtccgccggcgattggcgtttgttggtcacgtcggtggacctttcgtcccgcttgctcaggtggcgtttcagtgtgacaccacggcgtggcggcccgccactatcaaagccgtcgaaacgacaagggcggcggatcgttgttgttgggcaacgaccgccgcgcctcggcgctgatgcgcgactcattgagccgcgcaccgggcggcgtgctcctgggcccgggttcgttgccggacaggcatcatcacgccgcggtcccgctgcgatgcgggcagcgaggtgggcaacgtcggcttttccgggcaggcggccaacgctggaaagcaaagtccgccaagggtttggtggtgtggccgtgcccggtcggcgaggtccgacgcactgtgccgtcggtggcggcagagcagcttgaggttcgacggatgcgtcgggacgggcgcaaacggcaggtcgacggccgcagcccaactgtctcaccgggctacggcatgccacggcggatacatggcctccagcccgtcggcggcggtcgccgcgatggtgctgcgcaccatgtagcgcggctggtgcgccggccacggccggccgcgatgcatggttgcccggttgtcccacatcaccacgtcgcccgcccgccacgagtgcaggtagctcgcaccgggagcggtcgcggcctcggtcagcgccgccagcaactcccgcgccgcggccggctccatgccctcgatcccgtacgcgtgcgacgcgaggtagagcgccttgcggccgttgaccgggttgcgccacaccaggcgccagcattgcggcggcaaggccgcccgctcctccgggcgggccaggtcgggcgcgatcttgccgcgcgaataggcgtattcgtgccaggcgaacgaattctccacccgttcccgcaacccgggatcgagccgttcgaacgcgatccgggtggagacgtactcggtctcgccgccgcgccccggaacgatgcgtgacgacagcaccgacgccagcgccggcacccgcttgaacgaactatcggtgtgccacagctgattcgccttgttttccagggcgagccggtgatcggtgggcaccacgttgccgtcgtcgtcgagggtcttgaggaccacgaggtggctgccgcggcccaccgcacccaccttggtcacctccagcgggccgaaccggcgcgaaaaggcaagctgcgcttcatcactgacgtgctggtcccggaagatcagcaccgaatgctcctcgaacgccgcgcgcacctgcgcgtatacgtccggcgaagccgcgacatccgcgatcgtcaccccgcgcagttccgcggcaaaacccggtcccgacgccacgatctccatcggcgacctccgtcctgttgccggttacacccagtagggcacccgcgcccggtactggcgcatggcgaaggccgccagcagccaccccaccgccgtcaacaccaacaccaccgcccagtgccgcagctcctgatgcgaccccagcagcggcgcgcgcacgatgtcgaggtagtgcaacaacgggttgagctcgacgatgctcgaccagcgtccggcgccctgctgccgcagggtgtcgtcgttccagatgatcggcgtcatgaagaacagcaactgcacgaccgagaagagcagcgggccgatgtcgcggtagcgggtggccagaatgccgaaacacagtgacacccatatgcaattgagcacgatcagcgccagcgccggtatcaccgacaggtccgcccacgaccacggcttgggatagatcatcgcgatgacgacgtagatgacgatgttgtgcgcgaagaggatcatctgccgccacaccagccggtagacgtgcacgctcagcggcgtcggcaactgcttgatcagcccctcgttggcgacgaagacgtcggcgccctccaggatcgcggcgttaatcaggttccagatgatcagccccagcgtcacgtacggcaggtgcacggacagctccaggtggaacagcttggaatacaacccgcccatcgcgaccgccgtggttcccgtcgcgatggtgatccagaacggccccagcaccgaacggcggtagcgctgcttgatgtcctgccagcccaggtgcagccacagctcgtgccggcggaagccgtcgaccaggtcgctgcgggctcggcgcagggtgcgcgactgggccgccgcgtcaaggaaagtcatcgagatcctccaggcttgccgaacagctcgcgacgtcccaagcgccgcaaccggatccattcggccagccccctcgggtcgcgacgcgtcaccaggaagaaccagccgaaccggacccactcctgcaccagcagcttgcgcagccccggctgcgacagcaggtagccgcggttgcggtaggtgaagaaccgcttggtcgcgtcgtcgggatactgggtgtgcatccgaccaccgaggatcggccggaactcgtcggatccgcacggatgcaggtagaccgcgtccaggcaggtgccgaacggcagccccgagcgcaccagccgccggtgcatctccacctcgtcgccgcggatgaacagccgcaaatccgggacgccgatcgactccagcgccgacgcccggaacagcgcgccgttgaacaacgacgcaatcccagccagcaggtcctgcccggcctcggtgcgcaattcgcttgcccgcctacgccataccaggccgcggcgcaacggaaacgccaaccgttccgggtcgtcgaggttgcacaccatcggcgacacctcggccaggccgtgtttgtcggcgcaggccaacagcgtggccagcacccgcgcgtcctgcggccggccgtcgtcgtcggccagccatacccagtcggcgccctgggccagcgcatgcagcatgccgagcgcgaaaccgcctgcgccgccgaggtttcggcgagactgcagataggtggtcggaataggttgcgccgcaaccagttcacggacccggccgtcgtcgcacgcatcgttgtcgatgacgatgaggtggtccggcagccgggtctggctgctcagcgcgtcgagggacttggccagctcgtcggggcggcggtgggtgacgacgacggcgaagacggtgtcgctcatggctgttcggcggtctcggccagcacctcgcgcacatgccgggcggcgtcctcgccctcgtacgcgcgcaccacgtcctcgatgccgccggacatgcggatctggccgtggtcgatccacatcgccgtcttgcacagccgggccaggaattcgttggagtggctggcgaacaccaggattccggaccgctcgacgaggccctgcagccgcgactgggccttcttcatgaagtcggcgtccaccgcgcccaatccctcgtcgagcagcaggatttcggggtcgatgctggtgaccacgcccatcgccagccgaacccgcatgccggtggagtaggtgcgcagcggcatcgacaggtagtcgcccagctcggtgaactcggcgatctcgtcgaccttggccagcatctgtttgcgggtctgccccaagaacaggccgcggatgatgatgttctcgtagccggagatctccgggtccatcccgacgcccagatcgaagatcggcgccacccgcccggtgacctgggcccagccccgggtgggttcgtagatgcccgaaagtaggcgcagcagagtcgatttcccggccccgttgtggccgaccaggcccacgcggtcgcccagctcgagggacatggtgatatcgcgcagcgcttccaccaccaccacgttggaggtgttacgcccgatcgtgccgcccgccttgcccaggaaggccttcttcagcgaccgcgacttggcgtcgaagatgggaaactccacccacgcgttgcgcgtctcgatatgaggaccagaacccggcgccatcggtgtcgcgtctgcttacaggtactggccgtgcccgggcgcgctgcccggcttgccgatgcccgagggcaacgcgccctgacgcattttctccagctgcgcgcgggcggccatctgttgggcgaacagcgcggtctggatgccgtggaacagtccttccagccagccgaccaactgggcttgggcgatgcgcaattcggcgtccgacggcgccgcgtcctcgttgaagggcagcgtgaggcggtcgagctcctcgcgcagctcgggcgccaggccctcttccaactcccggatgctggtcgcatggatctcgcgcagccggttgcggctggcgtcgtccagcggtgcggcccgcacctcctcgagcagctgcttgatcatggtcccgatccgcatcaccttggcgggctgctcgaccaggtcggtcagcgagctctcgtcggcgtcgtcgtcgacccccatcatccgcgggtcgacaccaccgatgacttcgacgccgtcatcatcgttgcgggtactcaatccttcaccatcctttgtggactatgggtgtggcgtcgtggcttctgcgcgccattcgtagatccgggcaccgccattgtcgtagatcagcgcccacgacttcgacttatccagtgacactagtccttcgggtacggcgaacccccggacagtcggcgtgctggtgagtatgtacctgatattgagggctttaatcgccgcgaccacgcgcggatcggaatcgccgcggcgcgcgtacgcccagaagatgaatcggttgggacccgggcccatctgctgcgggtagtcgtagtgggtccacagcgggtgcaggtcggcgactgcgtacatccacgccgtgccgtcggtgttgccgttgccgatcagggtctcgtgcgcgccgggcagcttggccagataggccatggccatcaggtcgcgttggtcgatcatcaccgagtcgtacttgtccccgaacaacaccaggtgccggtacaggtagtggcgggcggacagcatggtggtggccaccagcaggaccgcggtggccgacacccagaccggggcgggcagcggccgccaccggccgccggcccgtttggcgccggccacgcaggccgtcacgaccagaaacagcgcgaggccggccatcggttcgagcagcagggtgatggcggccgagatgcggcgcggatccttgtagaagaactcgccgaaggcgccggccagcgcgccgatcgggccgcccagcgggttcccggcgtcgacgttcaccaccaccaggagcagccacacggccagcggccaccagatcttcttgaccagcagcacgattgcgccgatggccgccagcgcgatcagcccgtactggaccgggaagtcgttgaggtgacgggagtgctggaacacggcgtcgaacagtccgcgcttcttgctcaggtaggtcaggaaggaatgcccggcgatgatgtcttcctgctgctgcacgctgatgaactgcggcaacaggatcaacccggagatcgccgtcacgcagaccaaggccgcgacatcggccagccggccgcgcaccggatgccacagcgcgtccagcagccaccaggcgatcaggaacagcagcacgatgacgccgccggtgatgtgcaccgacatcacgcccaccagcgccagcacggccgccgggatgcggtcccggtgccgcagggtggaggtgatcagcacgaacgtcgggatcgcgacgccgtaggcggccaggttgggcatcgccgcgacgccgaactcgacgtagggcaccgcggtgaaggacgcggacagcgcgccggccgtcgcggcggcgcccgcggtgcgccattcgccccagctcggacgcagcagccgccaggtgagcagcgccgcgctggtcgggaacaaccacaccgacgccgcgaccgaactcaacgtgtagccggtggtgggcgccgcgccggtgagttggcagaacaccgcgatcagggcgtggaacaccgacgggtagtacagcatctggtgcgtctccacgttgcgcagctcgcccatgtgggtggacgacgcctggccggtgtccaggatgaaccgcacctcgttggcgtgccagaccgcgtcccaggtgctcgggatggtctgccagtgggcggccaggccgcggtaggccgcccacatgatcaggaacgcgcccagcagcacaccggccgccacggcggcggccggccagcggctcaccgcgcgcgcttcagcgtcgcggtcgcggaagcgggccagcagcagctgcaaaccggtcatcagcaggcacacgaccaccagcgcggccagcgcggtccagccgttccacggtattccgatggcgccgaacggaataatggccagcgcgaccatgccgtaggtcagcgccgggcccaccgcgacagcgatcggccacgtcaactgactgatacgtgcgatgatcgctccgggcgctatcagcaaaaacaatgcaatgagcgttccgaaccagagccccactcgactagtatggctggccgggtgccctggctcgggaggccaccgactggccggaacgtgtgtggcacccgctaccgtcacagtttcgcggaaaagcggaagctttaaggtggcctgcatggcatacgacgtcgcccgggtgcgcggactgcatccgtcgctgggtgacgggtgggtgcacttcgacgccccggccgggatgctgatccccgactccgtcgcgaccaccgtgtcgacggctttccgcaggtccgggcccaccaccgtgggggcgcacccgtcggcacagcgcagcgccgccatcttggaggcggcccgggcggcggtggccgacctgttcaacgccgaacccgcgggcgtggtgctgggcgccgaccgggcgatcctgttgtcggcgctggccgaggcctcgtcgtcgcgggccgggctgggctacgaagtgatcgtcagccgcctcgacgacgaagccaacatcgcgccctggctgcgggcggcgcaccggtacggcgccaaggtcaagtgggccgagatcgacatcgagaccggtgagctgccgacctggcagtgggaggggctgatcggcaagtccacccggctggtggccgtcgcgtcggcgtcggccacgctgggcaccgtcaccgacctgcgggcgatgacgaagctggtgcacgacgtcggcgggctggtggtggtcgaccattccgccgcggcgccctaccggctgctcgacgtgaaggagaccgacgccgacgtggtggcggtgaacgccgccgcgtggggcggcccgccgatcggggcgatggtgttccgcgacccggcgctgctgaattcgttcagttccatctcggccgaccccaaagcgaccggcgcggcccggctggagatcggtgcacaccagttcggcctgctcgccggggtggtggccagcatcgagtacctggcctcgctggacgaatccgcgcgcggcacccggcgcgaacgtctggcggtgtccatgcagtcggccacctcgtatctgaatcgcatctatgactacctgatggtgtcgctgcgctcgctgccgctggtgatggtgatcgggcgcccggaggtgcgcatcccggtggtcagcttcgccttgcacggcgtgcccgccgaacgcgtcgtacaacggttggcggacaacggaattctggccgtcaccaacgagagttcccgcgcgctggacgtgctgggcgtcaacgacgtcggcggcgcggtcacggtggggctggcgcactactcgacgacggccgaggtcgaccagttggtgcgcgcgctggcgtcgctgggctgaaccgtcagacggtcagcacgatcttcccggtgacctccgaggcgaccagccgtcggtgcgcgtcgccggcctgctggatgggcagccgggcgccgatgatcgggcgcacccggccgtcggcgatcatcggccacaccgaggcggtgactgcctgcacgatctcggttttgctgttcggcccgctcaccgggcgcccgcgcagcgtggtgccgatcacccgggcgcgtttggcgagcagcttgccgatgttgagttcggccttgacgccgccctgcatgccgatgatgaccagctgcccgtcggtggccagcgcgtcgatgttgcggtccagataggccgcgcccatgatgtcgagaatcacgtcggcgccgcgggtttcgtccgccagccgcgcgacgaagtcttcgtcgcggtagttgatggtgatgtcggcgccgagctcgcggcagaagtcgagcttctcggccgacccggcggtgacggccacccgggcgcccagcgcctgcgcgacctggatggcgtggctgccgatgccgctggccccgccgtgcaccagcagccgttggccgttgcgcaggcccgcgatcagcaccaggttggaccacaccgtgcaggcgacctcgggcagcccggccgcatccaccaggtccaccccggcggggatcggcagcagctggccggccggcaccgccacgtactcggcgtacccgccgccggccagcagcgcgcaaacctcttgccccacagaccattccgtgacaccgtcgccgacctcggcgatgacgccggacacctccatgccgatggtttcgctggcgccgggtggcggcgggtacttgccggcggcctgcagcacgtcggcgcggttcacgccggcggcggccaccttgacgacgacctcgccgggcccggcggagacgtcggctacttcttgccaggaaagctgatcggcggattcggcgacgatggcgcgcatggtggccacgctaccgagccccgttacccttagcagcggtggcgtggcagagcggcctaatgcactcgccttgaaagcgagagacggctaacaccgtccgggggttcaaatccctccgccaccgccgcgcgctcactcgacgctttggtgcagcgtcggtgcgtagcgcagcaccgcgcccaccccgtcggccggggcgatccgctcgtcggtgcgcaccaggttggcgcccaccttgatcgccgagaacggcagcgcctcgtcggcgcgcagcgtcctggccggggcggcgccctgctcggacagcacgttctcgttgggggcgacggtggtcaggccctcgtcggcgaccacggtggcgtcgccgatgtcaccgatgatcagcgtttccaccgcgccctggcgcagcgccgagcaaactgcgtcgagcccctgggccgccagccccgattgccgcccgatctcggcggtaaaccgctgtgcggcatcgtcgatggcgcgcagctgacgtttgacgaactcggcctcgatggcccgctcgatctccgtgaagtcgtggccgctgtgccgcgccccgacctcgagtgtcacggcgcggtcgtgcagccgttccggcagcgcggccagcaggtccgagcgcgaacgcacctcgccgaccacgaagatcacgtcgatcgccttgtcgtcggccagttcggcgacacggtcggcgacggcgcggacgttcttgcgggcggcctcctcggtgcgcaactgcgggtcgccgtatccggcggtctcggccccggccgccttgtgcaccgggtagccggtgccgtcgacggtctcgctgcgcagcgtgccgccgatgtgggtggtgatgtcggcgccgctgtggtccaccaccaccagcacatagtcggggtggtcgaagctctgctccaaaaccggtaccagataaggcaattcggacacccgcaatatggtggtggccgccgggcgggcaaggtgctcgttgatcagcacgccgtcggcgcccgcgatcaccgcccgcccgctgcgcccgatcggcgggcgcaggttcatcaccgcgtcctcgatgccggcgacgatcggcacgccgacgccgcggcgttccaggtcttctctgatcgcgcgccacttgagctcgagttgagcctcggcgtcgtgggtgtcgtgcgagtcgtcgaaatacaccgaaacgaacggccccggtgcgtccagcagtttgcggaagcgttgcgagtccatgctttagtggttgcccggcttgccggggcacaaacccgccctagtagctccggtctccctcgctgtcgtcgaaaaagtgccactgcccgtcgtgctcgacttccatgcgccaacccagctcgttgccttcgaccttctggtcggcgaaccaggcgtgtgctttgtcggcgctttcgatgtctttggtcgcgacgacgtcgcccttcgggttgagaactcgataggtagccatggcggcagtgttcccactgccgtgggcgtcaatcgcgggggatggcggcggtgatcgtgtccatcagcgccgtgtaccggcgcgcttccgggtcgcgtccgggtttgccgctgctgatgacgccggccgccaggccgcgcgcgggatcggcccagatcgcgatgttggtcagccccaggctgccgaacgcgtgcggcgcgttgcgcccgaacggcccccaccggttggtgcccaggatgaacccggtgccccaccgcgccggctgcagcccgaccgcgaaatccggtcgcagccttcggcattcggctacggcgtggtacacggtctccgggctgatcacccgcacgccgtcgagttcgcctccgcggcgccagatctcggcgaaccgcgacatctcgtgtgcggtcgacaccgtgttggacgacggaatgatggtcgtcaagaacatcggcgagttggtgtagggaatcatctcgtgcacggttccgccgatcgccttgcggaaaatctgcgccaccaccgggggcagggtgcgcccggtggcgtgactcggcgcgaccaacggcacgtcctgcttggcgacaccgaagttggtccagcggaagcccagcgggtcgaggatctcggtggccaggatctcgcgaatctccttgccggtggccgcatacacgatctcgcgcaccagcgggccccaggtgagcgcgtggtacatgtggaacagcccgggccggtagaggggccgcagctcgcccaacttctgctgcgcgtactcgtggtcgtcggcgcgggtgacgtcggggcgcggtccggtggggaagggcagcccggcgctgtgcgtcatcacgtgccggatggtgatccggtgtttgccgtgactggtgaacgcggggatgtagtcgcagacccggtcgtcgagggagaagacgccgcgctcgacgagcatgtgcaccacggtggccgcgatccccttggccgccgagtagacgcaaaacggtgtgtccggtgtgaccgggatcttctcggcgtcgggcgggtcgctgggcgcgttgccccagccgtgcccgatggcgcggttgagcaccacccgtccgtgccggcggatgcacaactggatggccggatggaagccgccctgataccagtgccgggcggccgcccagatccggtcgacggcggcggcgtcgatctcggagtggtcctcggcgccgatcgtcgtcaccgcgtccaggtcggcgggcaggcggatcttgccgtcgggagtcggggtcgtcacctcagcgagggtacgtgtcttactcgccggtgaactgcgccggccgcttctcgaacgtcgccgcgatgccctcggtgaggtccttggacggcaggaaggccgcgttccaggcggccacgtagcgcaggctctcggcgacggccgaaacgcgctgctggtcgaggacatccttgatgccgtgcacggtcagcggggggttggcggcgatctccgcggccgtggcatgcgcggcggccaggcacgcgtcggcgtcggcgtacacgtcgttgaccagcccgatcttctcggcgcgggcggcgtcgatgtccttgccggtcagcgccagctcgcgcaggtggccgtcgttgaggatgtacggcagccgggccaggctgccgacgtcggcgacgatggccagcttgacctcgcgcaccgagaacttggcgtcggcgctggcgtagcggatgtcgaccgccgagatgaggtcgacgccgccgccgatgcaccagccgtacaccgacgcgatggtgggggtgcggcagtcggcgacggcggtgatcgcgccctgcatccgcttgacctcgcggtggaagacggcgcgcggcccggccagcgcgtcgcccgacagcagcggggtgaacgatccgcccatcgccggcacgtccagcccgtagctgaagttcttgcccgaaccggtcagcacgatggcccgcacctcggggtcggcgtccagcgtctcgaacagctcgggcagctccgaccagaaggccggccccatcgcgttacccttgcccgggccgatcagcgtcacctgggcgacatggcccttcttctccacggtgaccgattcgtatgcttgcgccatatcgagaccgtagcgtggcgaacatggctcctgatttgcgacccggaccggattccccgccgaccgacgagctggacggcgccgaggcggcgctgcgggtgatgcagcaggtgctgcaccccatcgccgccgacgacatgtcccgcccgaccccgtgcgcgcagttcgacgtgacgcggttgacggaccatctgctcaagtcgctcgaggcgctgggcggcatggccggcgccgacgtcccggaccatgcggacagcggggactcggtggaacgccaggtgatcgcggtggcccgccccgccctggacgcgtggcggcagcgcggtctggacggcaccgtgtcgttcggcggcggtgagatgccggccaggaatgcctgcgccattctggcgctcgaattgctggtccacgcttgggattacgcgcgggcggtgggccgcgacgtccgggcacccgagccgttggccgaatacgtgctggggctggcgcaccgggtcatccgtcccgaggtgcgcggtcaggccgggttcgacgacccggtcgaggtgcccgccgacgccgatgcgttgaccaagctggtcgcattcaccggccgcaacccggcccgctaagcgcgaggccttcaccgaacgtgcattcagtgcgaaatccggcgcgttttttcgcggccagtgcacgctcggcgaaggccctagacccgctctaggtagaagtagtagtacttgccgttgtcgcgcacgcccttgccgttcatgatgcccatcacggcgttgtcgtcgatcttcttgaagtgatcgtgcaccggctgcccgtcgtagaccatggtcgcggtgacctcgccgcggaactcctccagccacaggctggcctcccccttgcccagctcgacgttggagaacttgttcccgtcggcgtccaggcagaccagcggctgcacatcgcgcgcggatttgaaggtcttgccgaaccatccggccttttccagctggccgttcatcttgtggccggtgcggaattcgccgcccttccactcgcccagcatttcctcgatggttgcgggcgcgagttccgcccagaagtcgtcgagctcactgtccgggatgtcgccgctgcgctctttgaactcggtgaacttcttgcgggcgaggtccacggatgactcctcagcgttcggtgcgggcgatccaatcgcaggcgaattgcaacagggcgtcgttttcggccggcgccccaatggtgacacggacgccctcggacgcgaacggacgcactaccaagcgcgcgttcgcggcctcctgcacgaagtcctcggtgcgcgacccgagcggcagccagaggaagttcgcctgcgagggcggcagctcgaatccggcgtcgcgcagggcggtgctgacccgggtgcgctcggcgaccagcgcgtcggtgcgggccatcagctcgccggaggcctccagtgacgcgatggcggcggcctgcgcgacgttggtgacggcgaacggcatcaccaccttgtccagcgcggtgatcagttcgggatgcccgatcgcgtagccgacccgcagccccgccagcccgtacgccttcgaaaaggtccgcagcacaacgacattcgagcggctcagggccagctccaggctgttgggcagcaggccgtcgcgaatgtattcgacgtaggcctcgtcgatggcgatcaggatgtccgccggcaccgcgtccacgaagcggaccagagcgtccgggtcgacgacggtggaggtcgggttgttcgggttgcacacgaagatcaaccgggtgcggtcggtgatcgcggcgagcatcgcgtccaggtcgtaggtgtgctcgcgcagcggaaccttgacggcgatcgcgccggccacctggacgatgggcaggtagcactcgaagctgcgccagcccatcatcacctcgtcaccggccgcggaggtgatctgaaccagctgctggcacaacgtgaccgagccgctgccgaccgcgatctgctcgggggcgacatcggaacccaggtgcatcgccagcgccgccttgaggtccacgcacgcgttgtccgggtagcggttgacgacggctaccgcgcgctcgatcgccgcgtgcacgctgggcagcgggccgtacacggtctcgttgctggccagtttgatggatcccggcacgttcttgccgggcacatacactggcagtccggccagttcggggcgcaggcgggcggtcacttcgacagtttatgtccccactgtgtacagtatggccggttccgcgagaccggaaaggggtcggtaccctcggaaagtccaagggaggcgtgccagagcggccgaatggggctcactgctaatgagttgtcccccttcaaggggaccggaggttcaaatcctctcgcctccgctgggtccccctagcggaaccacaactgaagacaggcgcccgtagctcaacggatagagcatctgactacggatcagaaggttaggggttcgaatcccttcgggcgcgctttttcagtgtatgacgtcggctgatgtgtgacgttttgtcttcggttgatgtgtgacggtgtttcggttgatgcgtgacagttgtttcggctgatcggtgacactccctagatgagggagttaagtgtggctgagcagcggtatcaggccgtgatggcggtaatcagtgacgggttgtcggtgtcgcaggccgcagagaagttcggggtggcgcgtcagacgctgcaccgatggctggcccggtatgaagccgcgggcctggaaggactggtggatcggtcgcatcggccggtgagttgtccgcatcagatgccggcggtagtggaggctgagatgttggagttgcgccgctcgcggccctattgggggccgcggcggttggtgttcgagttggccaagcgaggtgtccatccggtgccgtcggagtcggcggtgtatcgagcgctggtgcgggccggtctgatcgaccccgcgatgcgagatcgacggtcgcgcaaatggaagcgctgggagcgcggggcgccgatggagttgtggcagctcgacatcgtcggcgggttcccgctggccgatggcaccagcgccaaagccctgaccggcatcgatgatcattcccggatgtgtgtgtgcgccaagctgatggcccgtgagcgcacccgcgcggtctgcgacggattacgggcggcgctggccgcttacggggtgcctgagcagatcttgaccgataacggcaaggtgttcaccgagcggttttgtcatccaccggtcgaggtgctctttgatgcgatctgccgcgagcacggcatcgaacatctgttgacccagccgcgcagcccgaccacgaccggcaaaatcgagcagtttcaccgcagtctgcgcgctgagttccttagcggccgtgagcctttcaccaacctcaaggtcgctcagcaggcgctcgatgagtgggtcgaggactacaacaccacccggccgcaccaagccctaaagatgatcacaccggctcaacggtttcacgccggtgcgccggcatcaccaccgtcgaactcgtgtgcccgacacgtcgaccgcagtggtgatgactgggtgagtcggcgggtgtgctccaacggcatcgtgtgcgtgtcctggcagcaggtctgtatcgggcgccactatgccggcgcccgctgcgatgtccacgtcgatggggacctgctgaggttttgggtcggcgacaatctggtcaaaaccgccgcgcgcaccagccgcggcgaggtacgaaacaaacaggccctgcgcaccaacgcaccggcctaaaacacaacccagagtgtcaccgatcaaccgacatagaaatgtcaccgatcaaccgactctgaacaggcgcgctttttcagtcagctttcttcgcgtcaacgcccaccgaacggcccgccgaatgggccgccgtacggtccccgccgcggcggttcggtcacggtttgggtgaccgtgctcgtctcggtgctcggcgacaccgtgaccgtgctgggcggctcggtcgtggtgggggtgtcggtgctcgacggcgggacggtctcggtcaccgtctgggtcggcgccggggcgccaccgccaccgccgccgtggtggacggagtcgtcgtcgtggtggtcgtcgccgggctgtgcgccggggaactcgtcgccagcttgaccgcggcgaagacgaccgcgccgagcagcagcaccccgagcgcgccgaaggcgaccagcgccgccgggcggcgataccagggcgtgggcggctccggcggcgggcggtcgtcatacccgccgtactcgccgtaccccccgccgtatcgggcggcctgggtgggctcggagtagtagtccggatcctcgggatagggcggcacgaaagaagatgttagacgctcagccctgctcgtcgatgagtcgcagtgcccgctcgaacaaatgcaccgtggcagcgtgcaattggtcgccgacctccttctcggcctggcccgcgcaggcccgggccagcgtcccctcgatcacgatgcccagcttgaagcaggccagcacggtgtaccaggcgatgtgcgacaagtcgcggctggtgttggcggcatagcgccggaacagctcgtcggtgctggccaatccctcctggccgcccagggcgtggctgaacacggccgaaccgtccggctggcgccaggtggccagcagccagcccaggtccagcagcggatcgccgatcgtgcacatctcccagtcgacgatggcgaccacctcgggcccggtgcgggagaacatcacgttggccgcgtggtagtcgccgtgcatgatgcccggtgtccagtgcgccggccggtggcgctccagccacgccgaaacctggtcgatgccggggatctgcggcccgggatagccgtcgtattggctgtaggactccaattccgaaagccagcgcggcacctgccgttccaggaagccctccggcttgccgaagtcggcgaggccgacggccacgtggtcgacggcgcccagcttggccagcgcgtcggccatcgacaggcccatctggtggcgcacctgcggattgccggcgtgcagcggcggcagcccctcgccggcgttgaatccgtccaccggttccatcagatagaacaccgcgtcgcccagcacgccggggtcgtcgcacacggcaatcaggtgcgggtggggcacatccgaaccagccagggcggcaaggactttcgtctcccgcaaaatcacgttgttgctgcgcgggcgcaggtgccgcggcccgcggcgcaacacgtaggaccggccggcccggctgaaccgcagcatgacgttctgggtgccgccggtcagggtggcgacgtcatgcagcgggccctcgccgagtccctgcgccgacatccagtcggcgaccgccggtaggtccaccgcgtccacggtcatgccctcgggtgaggtgggcgtcatcgcactcccttgcaacctgtcgaccgtccgggaagaagccgtcgaccgtctgggaagaagactaggacagcggctggaacaatggccggtatgccgcggaccgacaacgattcctgggacatcacccaaagcgtgggtgccaccgcactgggtgtggccgccgcccgcgcggcggagaccgaaagcgaaaacccgctcatcagcgacccgttcgcgcgcattttcgtcgaggccgccggcaaggggatgtggagcatctatgccgacccggcgctgctgaccaaggcggacgacctcgagccggacctgcgcggccggctgcagctgatgatcgacttcatggccacccggaccgcgttcttcgacgagttcttcctcgccgcggccgacgccggagtgcggcaggtggtgatcctggccgccggcctggacgcgcgcagctggcggctgccgtggccggacggcaccgtcgtctacgagctcgaccagcccaaggtgctggatttcaagtcgaccacgttgcgcgagcacggcgcccagcccaaggcggaactggtcaacgtgcccatcgatctgcgtcaggactggccaaaagcgttgcaggaggctggatttgacgcctcgcggccggcggtgtggtcggccgaagggctggttcgttacctgccggcccaggcccaggacctgctgttcgagcggatcgatgcgctgagcgcgccgggcagtcggctggcgtccaacgtgcccgactcgggattcaccgatcccgaccggctggcccgccagcgcgaggacatgcggcggatgcgcgccgcggcggccaaactggtcgacgccgagatcaccgacttcgacgacctgtggtatcccgaggagcgcacgccggtcgacagctggctgcgcgagcgcgggtgggacgtctcgacggcgacgttcgcggagttgatggcccgctacggccgcagcattccgcagggggcgcaggattcgatgccgcccaccctctacgtgtccgcgcggcggcgggcgggctgagtcgaacgccgacatcgtaagcggcgccgttaatttcacggacccggggcgggccgcccgaattcagcggcggtcccgggcataaccaaatgcatgtttaaacatgggtccaacgggtaatttcagctgtcacgagaaatcttcttctcgaccaccttggaggtcacgatgcgtggcagcgggatcatcggaacggtcgcgttggtgtggttgctgatcggggttttcgcggcgtggcagcgtgattacttcaaaaacgaccaaacgacatgcgcgtcggcgggcacggttgcggtgaccgtgatcgccggaccgttgaattacttcggcgtcaacccgaaagttacggattgccatctgccgcaaccaagttcgatgcaatcgatcaacatctaaccgcgacccgaaggaatcgaaatggtcatcttaggaattgtgctgctggtgctcgggtatttcttccacgtgcccgtgctgtccacgctgggcatcgtgctgctggtgatcggcgcggtgctgtggatcctgggctcgatcggtcgcccggtcgccggccggcgctactggtactgaccggccggccggttcacaggccacgcaaaggtagggcatagccgcagctcagcccgcagcggatactgggacatgtgagccagccgcgagcctcagccgagcgggtcgtcatgtgccgcgccgacggcaacccgatcaacgtcctggtcgtcgacgacgaagccgtgctggccgaaatggtgtcgatggcgctgcgctacgagggctggaacatcgccaccgccagcgacggcgcctcggccatcgccgccgcgcgcaaccagcggcccgacgtggtggtcctcgacgtgatgctgcccgacatgagcgggctggacgtgctgcacaagctgcgggaggagaacccccagctgccggtgctgttgctgaccgccaaagacgcggtggaggaccggatcgcgggtctgaccgccggcggcgacgactacgtcaccaaaccgttcagcatcgaagaggtggtgcttcggttgcgggccctgctgcggcgcaccggcgtgacgaccgtggacagcggcgcgcagctggtggtcggcgacctggtgctcgacgaggacagccacgaggtcacccgcgccggcgagccgatctcgttgacatccaccgagttcgagctgttgcggttcatgatgcgcaactccaagcgggtgctgagcaaggctcagatcctggaccgggtgtggagctacgacttcggcggccgatccaacatcgtcgagctctacatttcctatctgcgtaagaagatcgacaacggtcgggagccgatgatccacaccctgcgcggcgcgggttatgtcctcaagcccgctcgctaggagcgatcgcaagcgcggcgaagccgggcgcagcgggtcgcgaccattggctaggagcgatcgcaagcgcggcgaagccgggcgcggcgggtcgcgaccattggctgacacgcgccgggtctggtcgctgcggctgcggctgctggtcggacagatcgtcgtgctggcgctggtgtgtctgggcatcaccgcggtcaccgaactggcgctgaaccatcacctggtcaagcagctcgacggccaactcgccggaacctcgttccgttcggcgctgatgtaccccgagcccaaccatccgcgccacgagcactcgccgtatccgaggccgggccccggcccgcggttcctggacgccccggggcagccggcgggcatggtcgccgcggtggtcagccacggcaagaccgtcgacgccggctacctcaccagcagcggcgcccgggacgcgctgacgtcgaccgcccagacccaactcgaacagatcgccggcagccgcgcaccggtcaccgtgaacctggacggtctgggtcgctaccgcgtcgtcgccgcccccagccgcaacggcagcgacatcatcgtcaccggcctgtcgatggccaacatcgacgccaccctgatccggatgctggtcatcttcgggatcgtcaccgtgatcgcgctggcggccgcgaccatcgccggggtggtgatcatcaggcgggcactggcgccgttgcgccgggtggcacaaaccgcgcgcgaggtggccgacctgccgctggcgcgcggcgaggtcgaattgccggtgcgggtacgggaatcggacgccaacccgtccaccgaggtgggccagctcggcgccgcgctcaaccggatgctcgaccacatcgccgacgcgctgtcggcgcgccaggccagcgagacccgggtacgccagttcgtcgccgacgccagtcacgaactgcgcaccccgctggccgcgatccgcggctacaccgagctgacccagcgcatgggcgacgaccgcgaggcggtggcgcaggcgatgagccgggtggcctcggagaccgagcggatgacccggctggtcgaggacctgctgctgctggcgcggctggattccggccgcccgctggagcgcgaaccggtcgacctgtcccggctcgcggtggacgcggtcaacgacgcccacgtcgccggccctgaccatcagtgggaactcgacctgcccgaggaaccggtggtggtcaccggggacgcggcgcggctgcaccaggtgctgaccaacctgctcgccaacgcgcgggtgcacaccggcgcgggcaccgtggtgaccacccggctgagcaccgagccggcgcacaccgtgctgcaggtcatcgacaacgggccgggcattccggcggagctgcagtcggaggtgttcgaacggttcgcccgcggcgactcctcgcggtcgcgcaagggtggcagcaccgggctgggcctggccatcgtctcggcggtggtcaaggcgcacaacgggacgatctcggtgaacagctcgccgggccacaccgagttcacggtgcggttgccacccaacggatggcaaccgcacgcgtcggcgtaggtcagctgttgcaggtcacatcgatctcgaacggcttgttgaccggctgcagcgggttggccatgtcgaccccggtcgcggtgccggtgatcttgtagctgttgccgttcttctcggccgacgcgttgccctggccggtgcccgaggtgtatccgagcgtcacgccgttgacattgcccagcccaacggatttcacctggggcgggttgccgtcgctgagcacggcggcgatgccggtcgccgcgccaccgatcgcgatgttgacggtgccaccggcattcgtgcacacgaccgaaccgctgacgttctggtccttgccgtcgatgatgaccttggtcccggccgccccgccgctgctcgccgacgcactggtgctcgagctgctcgcggaactgctgggagccgacttgttgccactcgaacagccggaaacacccgcggcaagaattgccgcgcccgcgaccgcgatcgtcagttgacgcttcacctgttctcctttgcccgaaagttgcggtcctcggcattgagggccgtctgcgcagtatgcgggtttgccgggtcgcgcaaaagaggttcggcgaaattgtttcgattcggttaaggccgcgttggtggcaaggttgttgtgatggaccacaaacctcccagcccggtaatcgaggcggcccatcgcgcatgcgtgctgccgttttccgacgacgcggatttccgcgacgccgatcgtggattcatcgccgcgttgtcgccgtgcgtggtgcggggcgccgacggccgcgtggtgttcgacaacgacgcctacgccttcctggacgggcccgcgcccacgtcggtgcatcccagcctgtggcggcagtccacgctggccgccaaacacggcctctacgaagtggttccgggcatctatcaggttcgcggccttgacatctccaacgtcacgttcgtggaaaccgacaccggcatcatcgtcatcgatccgctggtgtccaccgaggtggccgcggcggcgctgacgctgtaccgcacgcatcgcggcggcgaccggcccgtggtcgcggtgatctacacccacagccacgtcgaccatttcggcggcgtcctgggcgtcaccacccaggccgacgtcgatgccggccgggtggaggtgctggcgccggagggtttcgtcgaacatgcggtgcaggagaacgtctacgccggcccggcgatgctgcgccgcgccacctacatgtacgggacgctgctgccgcgcgggccccgcgaccatgtgggctgtgggctcgggcaggccgcctccatgggcgaggtggccctcatcgtgccgacagtcgacatccgcgagacgggggagacacacacgatcgacggcgtcgagatcgagttccagatggcgcccggcaccgaggcgcccgccgaaatgcatttctacttcccgcaattccgcgccctgtgcatggccgagaacgccacccacaacctgcacaacctgctgaccctgcgcggcgcgctggtgcgcgacccgcgcgcctggtccggctacctcaccgaggccatcgacaccttcgccgaccgcgccgacgtcgtgttcgcctcccatcactggccgacgtgggggcgggacggcatcgtcgaattcctgtcgctgcagcgcgacctgtacgcgtatctgcacgaccagacactgcgcctgctcaaccagggtcacaccggtgtcgagatcgccgaaatgttccggctgccaccggctctcgagcgggcctggcacgcgcgggggtactacgggtcggtcagccacaacgtcaaggcgatctaccagcgctacatgggctggttcgacggcaacccggcccggctgtggccccatccccccgaggcgctggggccccgctatgtggctgcgatgggcggcatcgaccgggtcgtcgacctcgcccagcaggcgttcgactccggtgattaccgttgggcagcaacccttttggaccacgcgatgttcaccgacggtgagcacgccggcgcccgcgagctctacgccgacacgctcgagcagctggcctacggcgcagagaacgcgacctggcgcaacttcttcctcagcggggcaacggagctgcgcgacggcaatttcggcaccgccgggcaggtcacctcgcccaccatgcttgcccagctgacgccggagcagatcttcgacggcctggccatccgggtcaacgggccacgcagctggggcctcgacatcaccgtcgatgttacccttgccgacacggcggtcaaccatcggctcgcgctgcgcaacggcgtgctggtgcaacgcaaggtgccggcggatcccgcgacggcgaccgttacggtgcggctggccaacaagattcggctgctggcgttggcggcgggggacttcgcctcgccgggtctggagctcaccggcgatcggggtgcgctgcaggcgttggtgggagcgctcgacgcgccggacccggacttcaacatcgtcacgccgtagcgccgccgctcacgcgacgtcgatcaccaccttgcccagcaccttgcggtcggcgacgtgccgcaacgccgcggcggtccgctcgagcggaaaccgcgccccgatgtacggccggacggtgccggcggcgaacatctgcgacaactccgtcaggtcgcgcacggcgtcgtcgggccggtcggtcatgaaggtgcggatctccatgccgcgcacgcagatgtccttgagcaaaacgagattgagcggaatggccgggatggtgccggacgcgtagcccagggtgacgaaggtgccgccgcgggccaggccgcgcagggccggctccgagtagggcccgccgaccgggtccaggacgacgcgggcgcggtcgccggtgagctcccggatccgcgtcttgaggtcctcgcggtcgtaatccaccgtcgcctccgcaccgcgccgccggcacagctcgagcttctccgggctggacgcggcggccagcacccgggcctgcatcgcgaccgccagatccacggcggccagcccgaccccgcccgcggcgccgagcaccaccacccaatctcccgccgtcacaccggcggtcgagcgcagcgcgtgataggcggtgcggtaggtgacgccgaaggccgcggcggaggcgaagtcggcgtcgtcggggatgggctcggcctgatcggcattcagcagcgcctgctcggcgaacgccccgaacgtggttccggccacccgctgtcccggaacgaaccgggcgccttcgccggcggcgatgacctcgccggcgatctcgttgccgggaatgaacggcggcggaatcttcacctgatatttgccggcgatgaacagtacgtcggggaagttgaccgcggccgcgcggacccgaaccagcagctggccggggccgggcaccgggtcgggcacctcgtcgagcaccaggtcctccggtgtgccgtaggaacggcagacgaccgcccgcatcagcgcacccccagtccacgcaaacagaaccgcaccacgtgggcgatgtcgtccggcgcgggctgctgtgccgagcccacgtagcggcgcagggtcgccgcagtgcagctgaacaccgcctcgacgtcgcggtcgacatcgctactgcccagcgccgcaacgggttcgacgagcagttcgcgaaggggccgcatcatctcctggtcggccgcgcgccaactggtgcccgccgacatctgaccggccgccgcccgggtcatgctgatcaggtgcgggtcggcgacctgcgccagcgtgccctcgatccagcgggcgatcttgccccgcggcgtggcctccttggccatctggtgctcgagataagacaccacgatggccaccccgcgctccatcacggccaagatcagctcgtccttgccggcgaaataccggtagaacgccttgttggacgaaccggcctcggcgacgatgtcgctgacccgcggcggctcgggtgcgacgcgttccatgacgcgcaccgcggcggccaggatgcgctccacctcctcggtggcctcccgctggcggtcgtcgagcgcgcgttcgaccgccgcggtcacccggtcagaaatcaacgagctcaccgtatttggcgcgggctgccgcgcgccgcacgtcgagcatctcgctgggccagtcgccgtcgtcggcctcataccccttgagtagcatccgggccaggttcaccttgtgcgcctcggtgggcccgtcggccaggcccagggcgatcccgccgagcagcacgttgaccagcggcagctggtcggtgagccccagcgcgccgtgcacctgaatggcccgcagcgcaatcgatttcagcacctgcgacgccaggatcttgcaggcggcgatctcggcgcgggcggcgcgctcgtcgccgttgtcgatcagccacgccgcgtgcagcacggtcagccggaacgggatcagctcggtgtaggagtccgcgacgaactcctgcaccatttgcttgtcggccagcagactgccttgggtgaaacggcttttcgcccgccgtgacatcatctcgaccgcgcgttgcgccatcccgatggagcgcatcgcgtgatgcagccgcccgccggccagccgggtctgcaggatcaagaagccctgtccgggctcgccgagcagggcgtcggcgggcacccgcacatcgttgtagtgcaccagggaatgccccggctcgtgcgggtcggcgcccaccaggtggtggttggcctccagcaccaggccctcggtgccggccgggattaaaaacgtcgaggcgccggtgtgcaccggcacgtcgggatcggtgatcgcgacgacgatgaagaacgaggcgacggacgcattggaggagaagtactttcgcccggtgatcacccactcgtcaccgtcgcggacggcgcgggtggtgaacacccgcgggtcggccccgccctgcggttcggtcatcgagaagcaggaaaagatctccccggacagcagccccgccaggtagcggtccttttgcgcctgggtgccgaaccgggcgatgatctcggcgttgccggtgtcgggcgcctgggtaccgaacacgatcggcgcccaggggctgcggcccaggatctcgttgatcagcgtcagcttgaccgcgccgaagccctgcccgcccagttccggacccagatgcggtgcccacaaccccttgtcgcgcacttgctgtttgagcgggtcgacgatccggcgccgctcgtcgttcagcggcaggaattcacagccgggaaagagcacctcgagcggttccacctcgtcgcggacgaacccgcggatccactccagcttctcctcgaactccggctcggtagaaaagtcccaggacatctcaatcgctcctcatcgggatcaggggattccaccgtcggcccgtaggatcgagccggtggtgaagctggacgcatcggaggccaaaaacagtgcggcgccgacgatttcacgcggatccccggcgcgctgcagcgcgaggtggcggaacggattctcttgcaccgcttccaggttccaggccctgctcacgtcggtcagaaacggcccggccatcagggtgttgacccgcaccgccggtccgaacgccttggccagcgcttcggtcatggcattgagcccggccttggacgcggcgtaggggacgatgtccggcgtcggccgcagcgacccggcggtgctcacgttgatgatggagccgcggccggccgccaccatgcgctcaccgaccaacgccgacaaccggaacgggcccttgaggttgaggttgaccacggcgtcgaacagcttctcggtgacgtcggtcagcttgtcgtacaacggcgacatgcccgcgttgttgatcagcgtgtcgattttgccgaaccggtcgtagctggcctcgaccagcccgtcgagctggtcccagcgcccgacgtgcacctgatacgccatggcgcgccggcccgtctcgtgctcgacctgttgtgcggtggcgacgcagttgtccaggttgcggctggcgatcaccacgtccgcgccgcagcgggccgcgccgaacgccatctcgcgtcccagtccgcggttgccaccggtgatcaggaccacccggtcggtgaggtcgaaaagctgttcagcataacccatttcagtttcccagctggcgggccagctcggccgccgtcgcgatcagttgcgggatcatcgccccgaacgcctcggtgatcttggggtcgactccttcgtttcgggagccaccgcgcacccccgccgcgtacgtcttctccagcacgatgcccagcttccagttggccagcaccaggtagtagtcgatgttctcggtggacaggccgctgacggattcgtagtgctccaacagctcgctgcgcgaaggcatcccgcgtatgtcgagatagaacccgtcctcccgcgggttttcaccgtcgtagcccagcaggcaccacgccaaatcgagcaggggatccccgacggtcgtcatctcccagtccacgatggcggccaggcgcgccggctcgccgtgcgcgaacatcacattggcgaactggtagtcgccgtgcatgatgccgggccggtagtgcgccggacggttgcggcgcagccagtcggaggcctcgtccaggccgggcagctcgcggacccggtaggcgtcgagaaacgccagccagcgatcgacctgccgctcgtggaatccgtccgggcggccgaagccctcgagtccttgcttgcgccaatccacccggccaagcttggcggcgccctcgaccagttggaacgccagcccgcgccgcgcccgcaggtcggtgtcgaacggcgcgggccacccgccgtccatcgggctccacccgtcgatcgccgccatgacgtagaacggcattccgagcacggtcccggtgtcgtcggcggcgatgagcgccgcgtgcgggacgtcggtcccggacagtgcgcgcaccaagcggatctcgcgcagcagcccgtcgatgcgggcggcgtccgcccgggcacccggcatgcgcagcaccatccgcgccgggccgcgctcgatcaggtagagggtgttctgggagccgccctgcaacggggtcagccgggcgtcttcgccgctgcccggtgcgtcgttcgcgtccagccagcgggccagaacgcccgcgtccagccccgattcgaccccaccgcgttgtccggccatcgctgcacaccccaatctcctcacggagaatagcattctcccgccgtcgggggctcaatccggcttgtgcgcgctcaccagaaatccgggcgccatgaagtggccctcgccgtcgtgttccagatgggccagcgggctgtccggcgccccggccgagtcgtcgttgccgtacacccgcgccgcgtgcaggtcgtcgatgtgccagagcaccgaaaccgcttcgcgcagctcggtttcggtgaaaccctgcgggcccggccggtccgggtgggccggcgccaacgccccggcggcgaaggccaggatgtacagcgcggcccccggagcggccgcgcggaagatcgaccgcagatagtcctgacgccgctgcggcggcagcgcgtggaacagcccgctgtccacgatggtggcgaagcggccctcggagccgggcggatagtcggcgaagtcggtcacgtcggcgcgcgcgaaagtcgcggtggtcaggccctgtgcggcggccgcggcggtcgcctcggcgatcgcggtggcgctggcgtccaggccgacgacggtgtggccgagcgcggccagccgcagcgagagggcggcgtggccgcagccggagtccagcacgtcgctgcggaacttgccctcgtcgatgagccgctccagctccggctggggccgcccgatgctccacgggggtggggccgcttggcggtaggcggcgtcccaatccgtgtccggctgggtcatgggtgctcctcgggatcggcgtcaccggacgcgatgagaaactggcgctgcccaccatcgaacgacgggaagaaatatgcaagtgcttctggtccggcacgcgctgccgctgcgcagcgaacacggccaaggctccgacccggatctgtccgcggacgggttggcccaaatcgagcggctgcccaaggcgcttgagcgctttcccatttttcgcgggtggtgagcagtccgcagcgccgcgccgtgcagacggcggcgccggtggcggccgaccgcgggctgagcgtcgagatcgacgaccggttcgccgaatacgaccgcgacctgccggtgtacatccccgtcgaacagatccgcgacgaaatgccggaggagtgggcgcgtttggcgcaggggcacctgcccagcgcggtcgacgaggacgcgttccgcgcccgggtgcgcgccgcggtcgacgacctcgtcgcggcggccgaccccgaggacaccgtcgcggtgttcagccacggcggggtgatcaacgtgctgctgcacgagatcctcggcacggcccggctgttgtccttccccgtcgactacgcgtcggtgacccggctgctgttctcgcggtccggccaggcgaccgtggccgcggtcaacagcaccgaacacgtctgggacctgctgccccgaaaccaaaggtggtgaacggggtgcgggccggcgatggtagacaagttcggtgacctcagctgaccaactcgaagggctcgacctggcggcgctggattcctacctgcgttcgctcggcatcggccgcgacggcgagttgcgcgcggagttcatctccggcggccgttccaacctgacgttccgggtgtacgacgacgccaccagctggttggtgcggcgcccgccgctgcacgggttgacgccgtcggcgcacgacatggcccgcgaataccgggtggtggccgcgctgcaggacacaccggttccggtggcccgcacgatcgggttgtgcgaggacgagtcggtgctgggcgcgccgttccagatcgtcgaattcgttgccggccaggtggtgcgccgccgcgcccagctcgagtcgttcagccacaccgtgatcgaaggctgcgtcgactcgctgatccgggtgctggtcgatctgcacagcgtcgatccggacgccgtgggcctggccgacttcggcaagcccagcggttatctcgagcgtcaggtgcgccgctgggggtcgcaatgggcgctggtgcggctgcccgaggaccggcgcgacgccgacgtggagcgcctgcattccggtctgggccaggccattccgcagcagagccgcacctcgatcgtgcacggcgactaccggatcgacaatacgatcctggacgccgacgatccgaccaaggtgcgcgccgtcgtcgactgggagctgtccacgctgggggatccgctctcggatgccgccttgatgtgtgtctaccgcgatcccgcgctggacctgatcgtcaacgcgcaggccgcgtggacgtcgccgttgttgccgacggccgacgaactggccgaccgctattcgctggtggccgggataccgctggcgcattgggagttctacatggcgttggcgtatttcaaactcgccatcatcgccgcgggcatcgacttccgtcgccggatgtcggatcaggcccgcggcctgggcgacgccgccgagcacacgcccgaggtggtggcgccgctgatctcgcgcggcctggccgaattggccaagctgcccggctagcgcccgccggccgcgtgctgctttttcgccacgcggcgcagctgcaggatccgcgcggtgccgaccgccaccgtgatcagcccgccgaccaccgcggccagcaggatcgccacccccagcggcaggctctaatgcaggcccaggaaccggaaggccgtcggcgcggtgttctgggtgatgaagatcagcaacagaatcaggatcacgaagccggcgatcagcgacgaccacagtgcgccggcgcgggtgaacccgatcgccggttccttggcgggtgcgggggtcttgcccgcaggggtcggtttcgggggctgctggccgggcgagtcaggggtgtggctgctcatgctgccatctttgccccatcaagcgcagaatgaaaccgattcccgtaacgggtccgcgcgggccggcgggtgggggtcgggaagttaaggtcggcggtatgacgatgcggctgcgcgtgcctgccgtggtcaggccggtggcggtgttgctgacgacgatgttcgtcgttgcggcgtgcagcaattccgacccgctgggagcgcaggtgcgcagccccgactcgatcgtggtcggctccggggacttcccggaatcgcagatcattgccgagatctacgcacaagccttgcaggccaacggtttcgacgtcggaaagcggatggggatcggcagccgggagacgtatatccctgcgataaaagaccattccatcgatctggtgcccgaatacatcggcaacctcttgctgtatttcgagcccgcgtcgagcgcgaccaccctggatgcggtcgagcaggagctgcaccggcgcctgcccgccgacctgtcgatcctgacgccggctccggccaccgacaccgacaccgtcagcgtgaccagccaagcggcgaactcctggaacctgaggacgatcggcgatctggccccgcactcggccgacatacgattcggggcgccctcggcgttcgccacccggccggccggcctgccggggctgcggcagaaatacgggctggacatcaaaccgggcaacttcgtcgcgatcgacgacggcggcggcgcggtaaccgtgcgcgcgctgctggagggacgggtgaacgccgccaacatcttcaccacatcgccggccataccgcagcaccacctggtggcactcgacgatcccgagcacaatttcatggccggaaacgttgtgccgctggtcaattcgcagaagcgctcggagcggctcaagctggtgctggacgcggtgtcggccaagctgaccacccccggcgtggccgggctcaacgccgcggtgtcggggaactcgggcgtcgaccccgaccaggctgcacgaaactgggtgcgggacaacggattcaaccacccgatcggaccttgacgtgatcgtcttcgccaacgtcagcaaggtgttcgcggacgggaccgccgccgtggaccggctcagcctgaccgtgcccaccggcaagctgaccgtcttcgtcggatcctccggcagcggcaagaccaccgcgctgcgcatgatcaaccggatgatcgagccacgtccggcaccatcagcatcgacggtgtcgacgtgtccaccctcgacccggtcaaactgcgcctgggcatcggctacgtcatccagcatgccgggctgatgccgcaccagagggtgatcgacaacgtggcaacggttcccgtgctgcgcggccagcgtcggcgggccgcccgcacggcggcctaccaggtgctcgagcgcgtcgggctggacgtcaagttggcccggcgctatcccgcccagctctccggcggggaacaacaacgggtcggcgtggctcgcgcgctggccgccgacccgccgatcctgctgatggacgagccgttctctgccgtcgatccggtggtgcgtcacgacctgcaaaacgaaatactgcggctgcaaagcgaattgcacaaaaccatcgtcttcgtcacgcacgacatcgacgaggcgctgcggctcggcgaacgggtcgcggtgttcaagggcggcgtgttgcagcagtgcgacgagcccgcccggctgctgtcccgcccggccaacgacttcgtgtcgaggttcatcggtctgggccgtggctaccgatggttgcaactcatcgacgccgccgggctgccggtgcacgacgtcccccgcctgtccgccgaaaacctgtcgggtgcagatgttttcgatggttgggccgtcgtggtcgacgaggccggggcgccgctgggctggatcgacgccgagggcctgcgccgacaccgcgacggcctggcgctgtccgacagcatgaccggcgtcggatcgctgtttcggccgcggggcaacctgagccaggcgctggacgccgcgctgtcgtcgccgtcgggaatcggtgtcgccgtcgacgacgacggcagggtgatcggcggtgtgctggccgccgacgtgctggccgcggtggaatcgcagcgaaagagccgctgatgcactatctgctcacccatctcgacgacgcggcccggctcaccgtcgtgcacctgcggctggcgctggtgccggtgctgatcgggttggcgatcgcgctgccgctgggaatgctggtgcagcgcaggcggtttgcccggcgcctgacgacggcggtcgccagcgtggtgttcaccatcccgtcgctggcgctgttcgtggtgttgccgatgatcatcggaacccgcatcctcgacgaggccaacgtgatggtcgccctgaccgcttacaccgccgcgctgctggtgcgggcggtgctcgaggcgctggacgcggtccccgcccagatatcggatgccgccaccgcggtcggctacccgcggctcagccggatgatgaaagtcgaactgccgcttgcggttccggtcctgatcgccgggcttcgggtggtggtggtgaccaacatcgccatggtctcggtcggctcggtgatcgggatcggcggactgggcagctggttcacccagggctaccagaccggcaagagcgatcagatcctggccggcatcatcgcgctgttcgcgctggcggtcgccgtcgacgggctcatcgtgctgggcggccggctggtcaccccgtgggcgcacgcggtgcgcggcggcgcccgccgctcggtcgtcgcgccggtggtggggggtgcccggtgaacttcgtgcagcgggccatcgcgtatctgctgagcgccgacaactggaccggccccgtcgggctggcggcccgcatcctcgagcatctcgagtacaccggcatcgcggtgggcgcctcggcgctgatcgccgtgcccgtcggcctgctcatcgggcacaccggccgcggcaccctgctggtggtgggcgccgtcaacgggctgcgcgcgctgcccaccctgggcgtgctgctgttcggcacgctgctgttcgggctgggcctgggaccctcgctggtggcgctgatgctgctgggcgtgcccgcgctgctggccggaacgtatgccggcatcgccaacgtcgaacccaccgtggtcgatgccgcccgggcgatgggcatgaccgagtcgcaggtgctgctgcgcgtcgaggtgcccaatgcgctgccgttgatcctgggcgggctgcgcagcgcgacgctgcaggtggtcgcgaccgccacggtggccgcctatgccagcctcggcgggctgggccggtacctgatcgacgggatcaaggagcgcgagttccacctggccctggtcggggcgctgacggtggccgcgttggcgctggtgctcgacggtctgctggccgtggcggtgtgggcgtcagtgccgggtaccggccggctgcggcgcacataccggccacttccgcaccggttggcggggacgtcttacggtagatgagtgaacgcagccccttctgacccgtctcgccgagtgtggcaggcgatgctcacctggcgcgcacaggacgtctcccggatggaatcggtacgactccaggtgtccggcaacagaatcaaggccaacggccgcatcgtcgccgccgccaccgacgccaatccggcgttcggcgcctactacgacctgcagaccgacgaaaccggcgccaccaagcggctcggcatgaccgtcaccctggccgagcgtgagcgtgtcttctccttcgcccgcgacgaggagaacatgtggctggtcaccgacccccagggcgagcaccgcgcggcctacaacggcgccctcgacgtcgacgtcgagttcagcccgttcttcaacgcgctgccgatccggcggctcggcctgcaggagcgggcggcctcggtcaccctgcccgtcgtctacgtcaacgtgccggagatgtccatcaccgccgacaccgtgagctacagcagcaccggcagccgcgacgagatcaaggtgcactcgccgatctccgacaccacggtcagcgtcgacgagcagggattcatcgtggactatccagggttggcagagcggatctgatcaccccgcccgcccggccggcggcggccagttcctgacgccagttctccgcgccgatcaccacgtggaagatgtcggtgcgcgggaagctgtcgtagcgggtgcgagcggcatggccggcctcgatgaggtcggcgaccgaattgtggtgggccagcgaatcgcgggcgcgccggagcaactcgatgacgtggtcggccgtcgggaccagttggtcggagttgccctcgcacatcgcccgcaccaggtcgggggcggtggccgccacccgggtgccgtcccggaacgatcccgcggccaacgcgaaggccaacggaacgtccccggcgaccacggccagcgcctcggcgagcaggtggggcagatgcgagatggcggccgcggcggcgtcgtgttcatcggatcgggccggcaccacgaccgcgccacagtccagcgccagcgtcatcaccatcgcccacaccaccgggtcgacatggtcgtcgacgctgaccacccagggggccccggtgaacaggcccgcgtggccggcggtccaccccgagtgcgcggtgcccgccatcgggtggcccccgacgaagcggtcccgcaggccggcggcgacgacctcgtcgagcaccgccttcttgacgctggtgacgtcggtcaacgggcaccgcggggccgtctccttgacgtgggcaagcatgctcggcagcgccggcatgggcaccgccagcacgatcaacgcgtcggagtcggcggcccgagacagggtggcggtcaggtccgtgtcggcgtcgaagccgtcggcggtggcggcctgcgccccttcgatcgagcggttgtagccgaacacctcgcggccggccgcggtggcggcgcgcatgatcgagccgccgaccagtcccagcccgagcacgcacaccggtgtcttcgaacgagggtgggagcgagggtgtgccacattcccaggttggcacatccggcgcgcgacgccgcgtgcagatgtcggggcgcccgtgctccatctggtcagggggcctggtcagggactaccgtaagcggccatgggagcacaacgggcctctgcccagggcctgtccgcggacacgccggacggtttcggtgtcgcggtggtgcgtgaagaggggcagtggcgctgcgccccgatggcccccaagtcgctgacgagcctgtcggccgccgagaccgaactgcgcgaactgcgcagctccggcgcggtgttcgggctgctcgacgtggacgacgaattcttcgtcatcgtgcggcccgcgccgtcgggcacgcgattgctgctctcggacgccaccgccgcgctggactacgacatcgccgccgaggtgctcgacaagctggacgccgacatcgacccggaggacctcgaggattcagatcccttcgaggagggcgacttagggctgctctccgacatcggcctgcccgaggcggtgttgggcgtcatcctcgacgagaccgatctgtacgccgacgagcagctgggccgcattgcccgcgagatgggcttcgccgatcagctgtcggcggtgatcgaccgcctcggtcggtgatttctgacgaagacctgatccgttccgcgctggcggttgccgcgacggcgggtccccgcgacgtgcccatcggcgcggtggtggtcggcgccgacggcaccgaactggcccgggcggtcaacgcgcgcgaggcgctgggggatccgaccgcgcacgccgaaatcctggcgctgcgggctgcggccgccgcgctcggggacgggtggcggctggaaggcgccacgctggccgtcaccgtcgaaccgtgcaccatgtgcgcgggcgcgctggtgctcgcgcgcatcgcccggctggtgttcggtgcctgggagcccaagaccggcgcggtcggatcgctgtgggatgtggtgcgcgatcggcggctcaaccaccgcccggaagtccgcggcggggtgctggagcgagagtgcgccgcgccgctggagggcttcttcgcccgccagcgattggggtgaccggcatgacgttcggtaagctgctcgacggtggcgtgtccgagcggcctaaggagcacgcctcgaaagcgtgtgacggctaacaccgtccgagggttcaaatccctccgccaccgccaaacttttccgccgagctgcgcgttgcggttcgatgtgagccgatggccgtagccgtccccggttggcgctccatcattccgaaccactaattttcctggggtgacattctcagctgccggcgcggtcgcgcggtggatcgtccctctgttcacggttgcggccctggtcggcataggcccggtagccgaaccggcgccggcagtgcggttggccgccgacggcaatccgttggccggggcgccgttctacgtcaacccgaactcggcggccatgcgcgccgcgcagagcgccgatccgccgagtcccgagttgaccaccatcgccaacacgccgcaggcgtactggatcgtgccgggcggctcggcggcgacggtcgggaagtacgtcggcgacgcgaacgctgccggcgccatcccggttttggcgatttatggaatcccgcaccgcgattgcggcagcttcgccgcgggcggcatggcgacggccgacgactatcgcggctggatcgacggcatcgcggccggtgtgggtacctcgagggtggcgatcgtcgtcgaacccgatgcgctcgcgatggccgactgcctgtcgggcgatcagcgccaggaacgctacgagctggtccgctacgccgtcgacacactgacccgcaaccccaacgcggccgtctacgtcgacgccgggcacctgcgttggcacagtcccgaggacatggccgcccggctcaaccaggccggcgtcgcacacgcgcgaggattcagcgtcaacaccgcgaacttttacaccaccgaggacgaaatcggttacggcgaagccatttccgggctcaccaatggtgcgcactacgtgatcgacacgtcgcgcaacggagccgggccggcgcccgactccgagctcaactggtgcaaccccagcggccgcgcgctgggcaccccgcccaccgcggccaccgcaggcgcccacgccgacgcctacctgtggatcaagcgtcccggcgaatccgacggatcctgcggcaagggtgatccgcccgccggcaacttcgtcaaccaatacgccatcgatctggtccacaacgtcggccactaggaccgctcggccgatctcgacccctgatggtcgcgaacgggtaacatttcgttatctaaaacagataaacgagcatgcgggcacgaggcgccatgacacggaaagccgagatcgtcgctgtcttcgcgatctgtactgccttcatgaccgcttccggcgcattcggcggcttcgccgcccgcgcggacgacccggagatcctgtacaacggcatcaaccagcttcgccaggcgtgcggaccgatcgccgaggacccacgtttgacggaagccgcgcagcagcacgccgacgacatgctgcgcaacggggtgagcggacacatcggttccgacggctcgtcgccgcaggcgcgcatcgccgccgcgggctatcgcagcaggtactcgggtgagatcgtcttctgggcaaccggttccgccgcgactcccagcgaagccctcgacatgtggatgcagagtcccccgcaccgggcgatcatcctgaactgcggattcaatgccggtggcttcgccaccgcccgggacggcaacaagatgaccgccgtcggtgatttcgcaacttcgtaaaacctaacggcgccattccttttgggcagtcacacgtggggcagccattttgagccgtgtggtgagagtatgaaggctcggtcttgggcgtctttgcatgcggtcgtgcctgagttatcgacaccgcagaccacgccttcgactgtaatggtgtgaaacggtgcgagagttcggatttggtggttttggatggcgctattgacatagggagttgatgtagcgggctggattcctgtgtcggtaccgacatacgtgtacggatttttgttctcgggcccgatccccggcaggttgttgcccgtacagcctgccgccggtggattgccgaagccgcatgttatgccatcgggcgtaacgaaatgcatctctttgagcggcaggtggccagggttgggaagggcgatggcatagtcggaagcgtcgaccggcgcatagccgctcatgtctgaaaagccgggcgaatcggcccgagcgatacagccggacgcaagagcactgacaaccgcggtggcggcaacgaggtattccgtcgcatcctggtcctatcggtgggcaggccggcggtccggttcacctcttgcgtgagagggtcggaccgcattgctctgcgctgcaagagaagcggagcccctcgtgtctagaaagcaaagctgcccgacggcttgagcacgaacccgtggtgaccttgggtggtgtccaagcatgcgacgaggtggtcgcttcccaccgcgcatgtggcgttgaaggcactcactttctgccccacgtctaaaagctttccgtgcgagaactgcccgccacacgggtggcccgtcttgttcagcgcgtaggcgggtcccatgcctgccgccgctgctctgcccacgacgcacgaaccgctgtccatcccggggaactcgccattgcatgttatggcttgctctgcccacgctggtatgacttcacccgcctcaaagaaacacgaaatgttgtaaggagtcgaaaagtaagcgaagggcggccctttctcgggtggttcgatgtagctctcgactggtactggtgcgaatgtcccgagatcgggaaacccgggcggttgcgcggcggcgtgttgcggcggtgatgtacaggacatggacaccaaagctgagattagcgctagccatcgcgtggccacattggcgacgttgcacatgtctcctcgatcagggcgtaacggtaaatgttcgtcgcagaggtttgcggattgtgtccggccttctgcgcctccaccagcgaggcggcgacgcgtgtaggtcggcggggtcgtagggcaacaagatgactgcagtcggcgatttcgcggctgcgtaactaggcggcgccaagatttttcggcaatcatacgtggggcagccattttgagccgcggggtgacaggatgaatcctcggccttgggcgtccttgcatgcggtcgtgcctaggttgtcgaccccgcagatcacaccgtcgacggtgatggaatgcattgggggcaaggttgggagtggatgtccatagacctgactgtcaggtgcaatcggattacccgtttgtgtcagcccagaagtggttccgatggcattgaccgtgcccgtcccgccagctggtggcacggcgggaaagttattgcccgtgtattgtgcctcacctgaaaagaaatcgcaggttatgccatccggggtaaggaaatacacggtattgagcgaggcacgcccggtgttgggaaggccaattgtgtagtcggacaccgtgaccggcgcataggcgctcaaatctggaaaactgggcgaaccggcatgtgctgcgcaagcgctgatcgcagctgcgacacatgcggcagtcacacgtggggcagccatttcgagccgtgcggtgacaggatgaagcctcggtcttgggggtctttgcacgcagtggtgccggagttatcgactccgcagatcacaccattgacagcgatggaatgcattgggggaagagttttgatgggctggccggcgattgaccggaatggctccccctcattcgtctgcttaagcccggtcgtcgttccgatccagttaaccccggtgattccggcatcaggttttgatggcgcggggggtatcgcagggaggttgttcccactgcactgtgcctgatcgggcgtgaaattgcagactacgccgtcgggagtgaggaagtaaaccgttggtaagggcggccgtcccgggttaggagcatcgagtgtgtaatcgctgggactgacggcggtgtagctattcaggtcgggaaatctaggtgtatctgcatgggcactgcaagcgctgatcgctgcgacacatgcggcagtcacacgtggggcagccattttgagccgtggggtgacaggatgaagcctcggtcttgggggtctttgcatgcggtggtgccggagttgtccactccgcagatcacgccgtcgacggtgatggaatgcattgggggcagcgtctttagctcttggccgttcgtgtcaagcggtgaccctgtgggttgcgggcccgagccggtactgatggtgatagcgcgcggcgccccgttggaggaggatgcggcgggtggtagacccggaagattgtcaccgctgcaaccggcagatggcgggttactgaaggcacaggacactccatcaggggtgcggaatgcgatcaattggaggggtgtcgggcgtcccgaatttggatatgtgagcgtgtagtcggctgggtttaccggcgtatagccactcagatcggggaatggcggcgaatcagcatgtgctgcgcaagcgctgattgcagcagcggtaatcgctgcggcgaaggaagtaatcgcgcgtgacatcttagtcgtccctcctgcatcgaaaagtcattgcggcggattaacctggacttgctgcacgccatatggggtattaagtgtggtgtcccactggctgatgaagatgttcagatcattaatagtggagttaggcaagatgtaacccccataaggttgtaagacagaaatgggagtgtggtcgttgtcgttgcgtgcaacggttgtcggggtattaccaaatatctctgttggattcccgtttgcgttacctatgtacagctgtacggcgcccgggccagcagttgcgttgaatcctgacagcacgggttgcccaccaatctctcggaagctcaattcaccgaatcgggtgccgggagccgtcacagtcgcggtggcaagatcccccgccttaccccagccggttccgttccagggttgccagcgatcgcgctgggtgacttcgcttggatcaactcggtacatcgttactccttggctgcggtcgaacgagtcggcggcaatgtagacatagccgtctttgccctggtagccgctaatctgcgtcggccccgccccaggggcgcgccacgacccatcgatcggcttccaaccttgaccaggatcattggtcaccttcacaagccatgaaccgcccgtcgggttcagctggtcggtgcctgcgaccatcatgtaggtggtgccgtcattcatccgaatgctgcccgcagggagcgtgtctttccccgctgcctgcggtggcggtggaaacaagacgttttggccgtctgctccggttagcggtgcgccgaaatggggatgaccttcctcgtcgaaggtaactgggaccgcaaccgatggataatgcgtgccgtcgtatgccttattacccgagaatgaatccccgaagatcgcgtagtacttgccgggctggcccggcacctcaacgacctcccccaggtccgccgctccgattccgggaatgcctgggttcgcgcccgtgccggcgacaggaccgaggttccgcactacaccgcgcaacggactttccatccagccgtcgacggctgcgggcggttgataaccgtcggtgtgcagattgcccatcgatttacgcagcgtctccgagtaggcgttccggattgaattcatctccttgacggcatcgcgcacgtcgtccacggcgtcggcgtgtgcgtccttgatcagtcgctccagcttggcccgctccgccgcgggcaggttgagcttcaaatcctctttggccgcgccgatgagtctgtcgaggaacatcagctcccgttccagcgtggcgatctcctgagccccggccttttgcgcctcggcgagtgacgcggcgatgccttccagatcggcggcaatcttgggcagctgcagggattgcgcgccaagggatttggtgacccgctgcacctcgtccgagtcgttgatcgggtggtcgccgttctggtgattccaggccgcgtcgaagcgcttgcgggcgtcctggaacgcgtggtcggcctccgcggtgcagcggccggcattgtgaaacgcctcggccaatcgctcgatctggaacgggctgccggcctgcaggctttggttgatcgcccagggatcacccccggccgacgcgatcagctccggttcgctgaggttcgtcagctgcacggcatcgtcagcggtcgtctggcatcgacgagcatcgccgcccccttctgagcaggtctaaccctactaccaagagggccggctcaggtcgggcttccggccagcttccgcaccgtcagggcttcgatgtcctggaacggccgcccctcgggccggatcaggtcgtggaaccacaccttgggcaccgaggtgtacggatgatcccatgactcccaggggaagtaggtctgcgtcttgccggcgaccaggccccagttgatggcgccgacgttgtgccgcttggccaccggcaggatgctctcgacggtgctgccccgcggccgggccatgtactcggtgcacaggatcggccggcccagcggggtgagctcgttgatcctcgactcgaagcccgcgggctcggcatacgaatggaaggtgatgacgtcggcgttggccagctggatgtcgctgattgcgctgcggccctgcggttgtccccaatccccgcgccacaccccactggtgagcggctgactggcatcgaccgcccgcgcccaccgaaacacctgcggcagcaggttggcgacgagctgctccttgtcgctccgttcgacgttgcggtactgccgcgccgggttgtccggctcgttccacaggtcccagcccaaaacccggtcgtcgttgcggaattgggtcatcaccgaggtgacgtagtcgcgcatgacggggatgtagcgggggtcgccgagacgctcggcgcccggactctgcacccacccggagttgtgcacgcccggccgcggggggcgctgccggccggcccggggctgcgggtcccagcacgagtcgaagaagacgaacagcggcttgatgcgatgtcgtgcggcgatgtcgacgaattgcccaaggcgggtttggaacccgcgctgatcggcggcccagagctgatcatgaaggaacacccgggccgtgttgtgaccatagaactgcgcccagcccagctcggtgtcgatgcgccggggatcgaaggtatcgggctggaacatctccagctggtttatggcgttggctggaatgtagtttgctcccaccagccaaccctgcgcctgataccagcggttggcgcgctcgggcgaccaccggccagcttcctccgccgaggcccggggcgcccgggcaactgcggcgcccgcggccagcagcaggggaagcttcagggccgttcgtcgttccacgatgtgacgataagttttcggggcgatttccccgggatttgctcagcgcgtcgcgacaggttgaagataacgattgttaccgggccgtcatcgtgaccaatccgtgaccatccgcctccggcgcgccccggcccatcgcgaacgtcggcaaggttacaatcgtccggtcgcgccctaacccgttggtggacaacgagtccggtaacccgatcggtgtctgcggcggcctgcggccatcatcgtcgatgacggcgcacgggaaaatccatcccacccagtcggcagaattacttcaaacttcacccccgcgagcgcaatactgaacgggtgcctgatcgaaacgtgctaggcggtccgctgcaaccctgtggcaccgatccgctgaccggtttctaccgcgacggctgttgctcgacgggaccgcaggaccttgggcggcacacgatttgcgccgtgatgaccgccgaattcctggagcaccagcgttccatcggcaacgacttgctgacgccggtccccgagtaccggttcccgggtctgctgcccggcgaccgctggtgcgtgaccgcgctgaactggctgcgcgcgcatcacgacgggtgcgcggccccggtggtgttggcgtcgacgcacgagagcacccttgaggtggtgccgctggaagcgctgcaggaacacaagatcgacgtccccgacgacctggccaacctctaggatcccggtgggttccgcggttgacgacatcgacttcgacgacctgacctcgccccggctcaccgacgtccaacgtcagatcctggagttcaccgaggccaagcccgtcgatctcgacatcgaccggatgctcgccgaggcgatcgaacatgccggcctgcccggcgccgacctcgacgacacgcacggcttcgtcgaccgtctgcacgtccacgtcgcggcgatcgaagccgaccacgggctgcgccagctcacccgggggtcgctgcggcaacgcgtggtgcggctgctgcgcaaccggttgtcgctgaccgagctgctccagcggtatcccgagatcgagtccatcccgatcgaggagccgctcatcgtcgtcgggatgccgcgttcgggcaccacgcatctggtgaacctgatcgcctgcgacccgcgccggcgcgcactgccctattgggagagccaggagcctatcccggcccgtggtcagggccccgacgtcttcggtgtcgacccccggtatgcccgcgccaaggcggaacgaggcgatcgaggaggaagtggaactgctcgacctcgatctggcctcctacgtcctggaatggcatgcgcgggtgcccgcctggcgcgatcactacctgagcctggaccaaacccggcactacgcctacctgaagaaggtgttgcaggcgttgaccttcctgcgcgggccgcggacctgggtgctcaaaagtccgcagcactgcgagcagctcggcccgctgatggcgaccttccccgatgcgacgatcgcgttcacgcaccgcgaccccgtcgcggtgatccagtcggcgatcaccatgatggcctactcggatcggttgcgccgcaccagcattgacccgcagtggctgctggactactggagcgaccgggtgcaccgactgctgagcgcctgcgtccgcgaccgcgacctggtggccccggaacgcagcgtcgacatcagcttccatcagttgagcggcaacgagatcccggtgatcgaacggctgtatgggcgcggcggggtggaattgccgcagcgggtgcgcgaccgctttcggcgctacctggacggaaatccgcgcggtaagcacggccgcatccgctaccagttgcagcgccatttcggcatctccgccgacgagctgcgcgcccgtttcggcttctacttcgacaagttcgacgtgcgccccgaatgaaggagtcagcgatgcccgaacctgtctatcggagcaggccgggtgccgaggcgatgcgcccggcgtccgcggagcgggccgaccccatcgccccgggactgtggtgctcgcccgggctgtccaactcctatttgctcaccaccgcggagggccgggtgatcgtcaataccggcatgggtttcgagggcccggtgcatcgcgccaacttcgacgccgtggattcctcaccggtgcgctacatcatcttcacgcagggccacgtggaccacgtcggcggcctggacagtgttcgcgacccggacaccgtcgttgtggcgcaagcgaactggacgatgtggcgcgacgacaacgagcggctgatcccgtaccgggccagccgcagcgcctttgccttcaaagacaccctggccggcggcatcaaggccatccagcggcgcctgggcaccacccggttgcccgggcagagcgtgcccgtcgtcgacctcgacttcgaggacacactgaccctggagctcggcggccggcggatggagctgatctcggtgcccggcggcgaaaccaccgactcgctggtggtctggttacccgacgaacgaatatgcctgtgcgggaacaccttcgggccgctgttcggtcatatcccgaacctggtcaccatgcgcggcgaccggtaccgggacgcgttgacggccatcgcctcggtggagcgggttcgcggcctgcgggccgagttgctggtgacgggtcacttcgagcccatcgcgggtgccgaccgcatcgacgaggagctcgcccggctgcgcgacgccctcggctacctccacgatcagacggtggccgggatgaacgccggcaaagacgtccgcaccctgatgcgagaaatcacgctgcctacggaatacgaagtgggccagggatacggcaaggtctcctgggacgtgcgcgccgtctgggagaactactcgggctggttccaccacgaatccaccaccgagctctacccggtcgggttcgacgcggtggcccacgacgtggtcgaactggccggcgcggatgcgctgctcgatcgcgcccgggcgcacctggccgccgaccgcgcgctgcacgcgattcacctcgcccagctgctgcccgccgaacacacgggggcacgcgaggtgctgcttcaggcccatgaaaaacttctggccagcagcacgaacttctgggaaagttcctggctgcgccaccagatagcgaggaactcatgacggcattcgcgctgcggcccgaggacttttatcacacgggcatcatcgtccccgacctcgaggcggcgatggcccggctgagcgcgctcgccgggtaccggtggatcaccccggtcagctacacgctcccgtttcgcaccgtgagcggaacccgggaagtgacttcgactttcgtctactcgctgcaagctccccacgtcgagctcatccaggcggtgccgggcaccgcgtgggcggccgcgcccggcaacgcggtccatcacctcggctactggtgcgacgatctggcgcagagcgcacagctgttggaagacaacgggtttgcgttcgaagcgacggccgacaccgccgccccggatctggcgttgttcgcgtactacgtcgatgcggcgggcacccgcatcgagatcgtcgaccgcgccctgtttcccgacttccccgccttcctgcaggccgccgccgcgccggaagcacagtgaggcggtccccggcatgctgctgacggtgctgcgcttcaacttcgcctccccgcacggtgatccacgcacccagagccggctgatgagcgccgcgctcgagctggcgcagtggggcgaatcgcacggcgtcacgtcggtcagcgtcgacgaacatcacgcgaccgggcacggctggagctgcaacccgatcatggccgcggcgatgttcttggcgcgcacctcgacgctgatcgccagcgtggattgcgccctgggcccgctgtggaacccgtcaccgtgcgggatctcgccaaccatcgcgccaccctgttgcaggggccccggttcgtcggcaccggcccgcaggtcgccgatcagatggcggactggttccaaaccggcgcctgcgacggattcgtactggccgcaacgcatctgcccggcgcattcgaagacgtggtgcgcatggtggtccccgagttgcaacgccgcggcctgttccgcaccgaataccggtccgcgacgctgcgcgggcatcttgggctgccgcgtcccgccaacgcccgggtggcccatgcttgacgggctgcgggtgctcgacctggccacgctggccgccgcgccgctggtggcgacctatctgggcgagttcggcgccgacgtgatcaaggtcgaagaaccacgccatggcgacccgatccgcgggtggggcaaccagcgcgacggtgtcggcctaatgtggaagtccatctcccgcaacaagaaatcgatcacgctggacctgcgcagcgcggaaggacaacagctggtccgccgtctggtggagcacgccgacgtcgccatcttcaacacccgtccccagaccctgcgcaaatggggactggactacgagagcctgcgcgcggtcaatgagcggctcgtgatgctgcacatcacgggctacgggttgagcgggccgaagagcgagcggccggggttcggcacgctgggcgaggcgatgagcggtttcgcgcacatcaccggccaggccggcgcgccgcccaccctgccgccgttcatgttggccgacggcgtcacctcgctgaatgccgcttacgcggtgatgatggcgttgtatcaccgcgacgtgcacggcgggccgggacaattgatcgatgtcaacctgatcgacccgctggcccggctgctggaacagacgctgctgggctacgaccagctgggactggtgcccgagcgatccggcaaccggtgggacatctccgcgccgcgcaacacctaccagaccgccgacgggcgatggctggccatgtccggcagctcaccggcgctggcgctgcgggtgttccgggcgatcggccgcgacgacctgctgggtgacccggagttctccgacccgcagcggcggctggcacgcgcccgcgaagtcgacatactcgtcgccgattgggttgcgggcaagacactttcggaggcgatggccgtgttcgaagcccacgaggtcgccgcagcgccggtctatgacatcagcgacctggtcgctgacgagcagctggcgcaccgcggggtgttcgtctccgtcgacgaccaggagctcggaccgatgacggtgcaggcgcccgttccgcgcttctcgtcggcgtccggcacggtcgagcatctcggaccccgcctcggtgagcacaacgccgaggtctacggggagctgctcggcctcacccctgacgaaatcgaccagctacgcgcccggggcgtggtgtgacagaaggaatttgatcgatgacccagcttcttcgccgctcggagctcgcggtgcccgccagcaacgacaacatgttcgacaaggccgccggaagcggtgccgacctggtgttcctcgacctcgaggatgcggtgccgccggctttcaaggaggagtcgcgcggcaaggcgatcagcgcgctcaacgacctggactggggacgcaccgcgcgggcggtgcggatcaacggcctcgacaccccgtggtgccacgacgacctcatcgaggtggtgaccgcggccggccgcaacctcgacaccgtcatcatccccaaggcgcgccgggcccgcgacgtctggtgggtcgacgtcctgctcagccagctggaggcaaagctcaacctgggcaacaagatccggctcgaggtgttgatcgaggaggtcgaggggctggccaacgccgaagagatcgcggtggccagtccgcggttggacgcgctgatcttcggcgtcggcgacttctcgctgtcccagggggcgcgggtggacaccaacttcgtgccgctgggcgaatatcccggcgatttctggcaatacgcccgcaacaaggtgatcgtcgccgcgcggatcgccggcatcgacgcgatcgacgcgccctatcccgactaccgcgacctgacgggatatgagcgcgacgcccggcgggccgcactgatgggatacaccggcaaatgggcgatccaccccgaccaggttcctgtcgccaaccaggtttatgcgcccaccgccgacgaaatcgcccgcgccgaggccaatctcgccgcctaccgggaggccgagagcaacggccgcggcgccgtcggggtcaacggcgtgctggtggacgccgcgcacgtgaagatggcgcagcagacgctggcgcgcgccgccctgatcaacggcaccggcggatcgaacgaccgctagtcgatcaccatcaggaggtcgccgccctcgacttgagcggtccgcgacacggcgatgcgcgccaccttgcccgacttcgggctggtgaccgcggcttccatcttcatcgcctcgatcgtcgcgatggtctggccggcctcgacctgccggccgacctcggcggcgaccgtcaccaccccggcgaacggggcggcgatgtggtccgggttggcgcggtcggccttctccgcggcgggcacgtcgatggcgatgctgcggtcgcgcaccaccaccggccgcagctgcccgttgagaatgcacatcacagtgcgcatgccgcgttcgtcgggatcggagatggcctccaggccgatcagcaactccacgccgcgctcgagttcgacgcggtgttcgtcgccctgccgcaatccgtagaagaactggttggcgctcagccccgaggtgtcaccatactgctcgcggtgctcctcgagctccttggtcggtcccgggaacagcagccggttcagcgccgcctgccgtcgcgcacccggggcggccaacgccgctttgtcctcggccgtcagcggctgctccggcttggccggtccccgaccctgtaaggccttggtgcgcaacggctccggccagccgcccggcgggtcaccgagctcgccgcgcagaaagccgatcaccgaatccgggatgtcgtagcgggaggggtcttcggcgaagtcctgcgcgcccacacccgcacccaccagggccagcgccaggtcgcccaccaccttgctggacggggtgaccttgaccaggtgtcccaaaatcgcgtcggcgccggcgtaggcgttttcgatgtcctcgaaccggtcgccgagtcccagcgcaatcgcctgctgacgcagattcgacaattggccgcccgggatctcgtggtgatacacccgcccggtcggcgccggaagcccggattcgaagggagcgtatacctttcgcagcgcctcccagtacggctccagatcgcacaccgccggcagggacaacccggtgtcatactccgtgttggccgcggcggccacgatcgacgacagtgccggctggctggtggttccggcgagcggcgcggcggcgccgtcgaccgcgtcggccccggcctgccaggccgccacgtaggtcgccagctgtccgcccggcgtgtcatgggtgtgcacgtgcaccggcaggtcgaaccgcgacttcagcgccgacaccagcgtcgcggccgccggtgcgcgcagcagcccggccatgtccttgatcgccagcacgtgtgcgcccgcttcgacgatctggtcggccagcttcaggtaatagtccagcgtgtacagcttttcggccggatcggacaggtcgccggtgtaggacatcgccacttcggctatggcgcttccggtttcgcggaccgcggcgatggccgggcgcatcgagtcgacgttgttcaacgcgtcgaagatgcggaagatgtcgatgccggtgtcggtcgcctccgcgacgaaggccgtcgtgaccgtctccggatagggcgtgtaccccacggtgttacgcccacgcagcagcatctgaaggcagatgttcggcatcgcctcgcgcagcgccgccagccgctcccacgggtcctccttgagaaaccgcagcgccacgtcgtaagtcgccccgccccaacactccaccgacaacagctgcggcatggtccgtgcgatgtagggcgccaccttgagcagcccgctggtgcggacccgggtcgccagcagcgactggtgcgcgtcgcggaacgtggtgtcggtgacgccgacgccgcccgactcgcgcagccaggccgcgaatcgctccggaccgagttcggtcaaccgctgcttggagcccgccggcgggctcgccgccaggtcgatgtcgggcagcttgtcatgcgggtacaccgccgacgggcgctcgccgtgcggcttgttgacggtcacgtcggccaggtagttgaggatcttggtgccgcggtcggccgaactgcgcgcggtgagcaactgcggccgttgttcgatgaacgaggtggtgatgcgcccggcctgaaaatccaggtcgtccataaccgcttgcaggaacgggatattcgtcgatacgccgcggatgcggaattcggcgaccgcgcgccgcgcccgtcgcaccgccgtggggaagtcgcgtccccggcaggtcagcttgatcagcatcgaatcgaagtgcgcgctgatctcggcgcccagcgtggtgccgccgtccagccggatgcccgcgccgcccggggtgcggtaggcggtgatgcggccggtgtccgggcggaaaccgttggcggggtcctcggtggtgatccggcactgcagggccgcgccgcgcgggatgaccgaatcctggctcaggccaatctcttccagcgtctggccggaggcgatgcgcagctgcgcggacaccaggtcgacgtcggtgatctcctcggtcaccgtgtgctccacctggatgcgcgggttcatctcgatgaacacgtggttgccgcgttcgtcgagcaggaactccaccgtgcccgcgcaggtgtagccgatgctgcgtgcgaacgccaccgcgtcggcgcagatacgttcgcgcagcgccggatccaggttgggcgccggggcgatctcgatcaccttctggtgccggcgctgcacgctgcagtcccgctcgtagaggtgcatcacgttgccgtgcgtgtcggccaggatctggacctcgatgtgccgcggattgatcaccgcctgttcgagaaacaccgaggcgtccccgaacgcggactcggcctcacggctggccgcctcgatcgcctcggccagcgcccccggatcggtgactcggcgcatcccgcggccgccgccgccggcgaccgccttgacgaacagcgggaacgtcatcgtctcggcggcgctcagcagctcctgcacggaggtcgacggcggcgaggaggccagcaccggaagacccgcggcccgcgccgccgcgatggcccgcgacttgtcgccggtgagctcgagcacctcggcgctggggccgacgaacgtgatgccggccgccgcgcacgccgccgccagatcggggttctccgacaggaagccgtagccggggtagatcgcatccgcgccgcaggccagcgccgtgtcgacgatctcgtcgacggacaggtaggcgcggaccgggtgaccttcctcaccgatctggtaggactcgtcggccttcaaccggtgcaccgaattgcggtcctcgtagggatacaccgccacggtggccatttccagctcgtaggccgcgcggaacgcgcggatcgcgatctccccgcggttggcgaccaggactttcgctaacacggttcttacgatagagcgcgttgcggcggtccgacatactcgctgagcggacggatcaacgcgttggaggcggtctgctcgatgatgtgtgccgtccacccggtgatccggctcatcacgaaaatcggcgtgaacgccccgatgtcgaagcccatcaggtagtaggccggcccggtggggaagtcgaggttgggtttgatgccgttggcccgcgccattcctctttccaggatctggtagatgtccagccacttctggccgtcgcgcaccgcggcgacgcgctgcagggcttgcttcatggtcggcacccgcgagtcgccgttcttgtagacccgatgcccgaaacccatcaccttctccttgcgagaaagcttgccctgcaaccattccgcagcacggtcgggggtcccgatttcgagcatgtcgtgcatgacggcttcgttggccccgccgtgcagcgaacccttgagcgcgccgatggcggcggtgaccgcgctgtagatatcggactgggtggaggtgactacgcgcgccgcgaaggtcgaggcgttgaagctgtgctcggcgtacaggatcatggactgttcgaacgcgtcgacgatcacctgctcgggcacatcgccgaaacacatgtgcagaaaattctgcgcatagctcatgtggctgtgcggggcgatgggttccaggccgcgccggcggcgcatgtcggccgcgacgatggtgggcagcaccgcgaacatccgcagcgccttggcgtggttggccgacgcgctgttgtcgtcctcgtcggggtcctcggcgcccatggagctgatgaaggtgcgcaccacgtccatcgggtggcaggtgtcgggcagcttgtgcagcagcgacagctgggatcggttgagccggcgggcggctcgttcccgctggctgaacagcgccagctgctggtcgtcgggaagctcgccgtaccacagcagatacgcgacctgttccaagctgcagtgggccgccaggtcctgcacggcgtagccgcggtaggtcagcgagttggtctccgggaccaccttggagatggcggtggtgtcgacgacgacaccggccaggcccttgtggatacggggctggttgtcttcgagggtgctcatggcacgactccttaccgggggaagttgtagatgtcggaatcgaagtggttgtagtcggcgtagcgcagcagctgatagagccggctgcggtgctgcatgcggtccagcaggccggattgcgttccggtatcggcgatttcgcgcagcccggcctcgacggcgtgcatggccagccgcagcgtggtcaccgggtagatcaccacgttgtagccgatgtcggcgagcaagccggtgctgagcaacggcgacttgccgaactcggtcatgttggccagcagcggcgtgtcgagggcggcgcggaatcgctggaattccgtggggctttgcagcgcctcggtgaagatcaggtcggcgcccgcgtcggcgtaggcccgggcccgttcgatcgcggcgggcaggccctcgatcgcggcggcgtcggtgcgggcgcagacgacgaagttcgggtccctgcgggccgagacggcggcgcggagccgtcgcaccatcacgtcgaccggcaccaccgccttgccgtcgagatgtccgcaccgtttcgggtttacctggtcctccaggtggcagccggccagcccggcgtcctcgagcatcgtcaccgcgcgggcggcgttcagcggttcgccgaacccggtgtcggcgtcgatcagggtgggcagctcggtgaccgcggcgatctgggcgccgcggccgctgacctcggtcagggtggtcaggccgatgtcgggcaggccgaggtcggccgagagcgcggcgccggacacatacaccccgtcgaatccgagttcggcgaccagcttggccaccagcggtgagaaggcgcccggaaagcgttgcagccggccactttccagtccggcgcgcaattgcgcccgcttctgttccggggaacgggcggcgccgatcagaccatgcatcagaagatcccgcccggaatcgccggggcggtggccagcaccgccggatcgaccacgatgttgagttcacccgccgcgcccggcggcaatgcgggcaggccctcggcgaccgacaggaaccgctgctgctcggcgtcggtgacgacaccctcggccagttcgtggaatttgccgacgtactgcgtgcgttcgaaaggccgggcccccaacgggtgagcgtcggcgacggcgagctcgtcgacgatcacctcaccgctgttgagggtgaccacggcgcgggccccgaacgccttgtcgttcgggtccgtggagtggtagcgccgggtccactcggggtcctcgacggtcgagatcttgcgccacagctcgacggtgtcgggccggtgtgcgcgttcgggcgcgtaagacctttcgtggtgccaggttccgtcctgcagtgcgaccgcgaagatgtacatcaccgagtggtccagcgtttcccgcgaggcgtccgggtcgaatttctgcggatcgcccgccccggtgccgatcacgtagtgggtgtgatggctggtgtgcagcacgatcgtggcgatctgattcagatcgccgatgcgctcccgcatccggcgggccagatcgatcagcgcctggctctggtattcggccgagtgctccttggtgtagctgtccaggatggcgcgcttgggctcaccgggctcgggcagcgggacccgataggtgtgctcgggacccgacagcagccaggcgatcacgccgtcctcgccctcccaaatcggtgcgggcgcactctctttccgcatggcgcggtcgaccgcctcgatggcgaccttgccggcccaggccggcgcgtacgccttccagctggagatcaggcccttgcgcgactgccgggtggacgtcgtcaggtgcaacgcctgcccgatcgcctgatagatggtctcgggatccagccgcaacatggtgcccaggccggcggccacggacgggcccagatgcgcgacgtggtcgatcttgtgctcgtgcaagcagattccccgggccaggtcgatctggatctcgtaaccggtggcgatgccgcggatcaggtcggcgccgccgacccccaggtgctgggcgacggccaccagggcgggaatgttgtcgccgggatgcgaatactcggcggccagaaacgtgtcgtggaaatccaattcgcgcaccgctaccccgttggcccaggccgcccactccggggagtagtcgccccggatcccgaaaaccttggcgcccttggccgccgcgggatgcgcctgggcctgagcccgcgcgacggtcaccgggcgccggagcaccgacgcggccgacaccgccgcgttgtcgatgacgcggttgatcaccatcgcctcggtctccgccggcaccgcgaccggatcggccgcgacctcggcgatcttccacgccaggtgctcgctgcgggggaaatcctcggcgctgcgccgggttcgaacgtcgtggatgcgcataaaccgcaccctacgcacccggctgaatacggtaaatgcgctgtaagagcgtaattttgcgtccttgcccgactgtgtttgcgaactttgtgaaaggcgctgggcgtagggtggtgcgggtggcgaagacgttcgccggggcgcggctgcggcgattgcgcgaggagcaggggctgacccaggtggcgctggcgcgcgccctggggctgtcgaccagttacgtcaaccagctggaaaacgaccagcgcccgatcaccgtcccggtgctgctcaccctcaccgagcgtttcgatctgcccacccagtacttcgcgccggactccgacgcccgcctgatcgccgacctgcgggaggtgctcgccgaaacgcccgcgacgcccgggcaggtcgaggagttggtcgcgcgcatgccggcgatcggtcagaccctggtcaatctgcaccggcggctgcacgacaccaccgccgatctcgaagccctgtacagccgcgccaatctggacatctcggacacgccggggctaccgcatcagccgatgccgttcgaggaggtgcgggacttcttctacgaccgcaagaactacatcggcgagctggacgtggccgccgaggaaatgttcgaccacaaccggttgcgaatcggcgggctcgacggccagctcgcccggctgctcggcgagcagctgggtgtggcggtggtgatcgacgacggccagctactggccccgaactccaagcgcctgttcgatcccgagtcgaaaacggtgtacctggcccgctggctgcaccccggtcagcgtgcctttcaattggccacccagatcgccctgctcacccagccggaattgatcaccgcgatcatcgccggcgacgatcagctcagcgacgatgcccgcggtgtggcccgcatcgggctggccaactatttcgccggcgccctgctgttgccctaccgcagattcctcgacgcggccgagcgcgtccgttacgacatcgaccagctgtcaaggagattcgaggtgggcttcgaaaccgtctgccatcggctgtccacgctgcaacgcccgaacgcccgcggggtgccgttcatcttcgtgcgcaccgacagcgccggcaacatctcgaaacgccagtccgccaccgcttttcacttctcccgggtcggcgggaactgtccgttgtgggtggtgcaccacgcgttttcccggcccggccagtttttgacccaggtcgcgcagatgcccgacgatcgcacctatttttggatcgcccgcaccaccagcggcgggccgagccgttacctcggcccgcacaagagcttcgccatcgggctgggttgcgacgtggaccacgcggacaaactgatttactccgtcggcatcgatctgcgcgacaccgagtcgatcgtgccgatcggcgccgggtgcaagatctgcgatcgggcggcctgcccgcaacgcgccttcccctacctcggccgcccggtctccgtcgacccgcaccgcagcaccgacctgccctacccgcccgcgatcacgccctgagcccggtcaggtcgggccgcccgcccaggcgctgaaccgtggccccggcggccgcggccgcccgccgacccgcctcccgcggtgcggcgccgtcccgcagggcggcgaccagcccggcgacgaacgcgtcaccggcgccggtgggatccaccacttccacgtcggcgaactcgaaaagctcgctgccaccacgccacgtcagcaggtcgcccacgtcgggaaccgccagcgcgaccagctccgggccgccgctcagcagatggtcggccagctcgaaggcctgttccaccgtggtgatttcggtgcccgcgatgatcgacgcttcggtggcatcggcccgcagcacgtccagcgtcgccagcagatcggcccgaacctgcggggcgggcacgccgtcggccaccacccgcagtccccgctgccgcgcgcgttgggcggcttccaaagcggtggcggccggctgctgcagctgaatggagacggtgtcggcggtgtcgaacagcgagctcgaccggtccaggtcggcgacccgaaccagcgaactgtccggcacgtcctcgagcagcatgcgttccggcggcgcggcgaccacgtcgaccagcagcgcggtggtgccgcgccgcgccactttgctgacgtcgatgccgtcgcgctgcgcctgctgcaggatcgacgtgccggcctggtcgtcgcccaccaccccgatcagcgccaccggcacacccagttgcgccagcccgacggcctggttggcgcccttgccgccgagcagctcctcgcgccgcagcacggtggcggactcgccggccgtcggcggccggtcggtgcgcagcaccaggtcgcgcccgatctgaccgatcaccaccacacccatgactacacagtgcccgctttcggcgcgccgaacacctgcggtcccttgacgggaccgccgcggtgatggtccagtgagccatgcatcggatcggggacacggcgtgcccaggctagcgattctcgacgactacgccggggtggcgctgcaggtcgccgactggtcgcgggtgcaaaagcggtgcgacatcaccgttttcgacgagcacctgtccgagcagcaggcggtggacgcgctgcggccgttcgacgtggtgtgcaccatgcgcgagcggatggcgttcccgcgcagcctgatcgagcggctccaaccggcacgtgctggacgccatcggcgatccggcatatcaggtcaaattgggcgcctacaacatcgagttcaacgttccgccgcacgcgctgcccgggcacaccggcctggatctcgaggccgaggtgcgggccagcctgaacgaggccgagaccaaggccggcgcggccggcggcgcgcacatcgtcatgatcggcatcctgcccaccctgatgcccgaacacctggaccacgactggatgagcgaatcgacgcgctatgccgcgctcaacgactcgatcttcaccgcccgcggcgaggacatcccgatcgacatctctggtcccgagccgttgagctggcacaccgcgaccatcgcgcccgaatccgcttgcaccagtacgcaactgcatctgcaggtggccgccgagacgttcgcggccaactggaacgcggcgcagatcgtcgccggcccgcagttggcgctgggcgccaactcgccgttcttcttcgggcaccagctgtgggccgagacccgcatcgagctgttcgcccagtccaccgacaccaggccggaggagctgaaaacccaaggcgtacggccgcgagtgtggttcggcgagcgctggatcgattcggtcctcgacctgttcgcggagaacatccgctacttcggatcgctgctgcccgaggtgtccgacgaagacccggtcgccgagctggccgccggccgcacgccgcagctttccgagttgcggctgcacaacggcaccgtctaccggtggaaccgcccggtgtacgacgtcgccgacgggcgcccgcatctgcggctggagaaccgggtgttgccggccgggccgaccgtcatcgacatgctggcgaactcggccttcttctacggcatgctgcgcagcctgtccgaggccgacgacccgctgtgggagcgcatggatttcgctgtggcagaagccaatttcctcaccgcggcgcggcacggcatcgacgcccggctgcgctggcccgggttcggtgaggtgagcgcgcgcgagctggtgctggacacgctgctgccgatcgccgacgagggactgcgccgctggggggtggatgccgaggtgcgcgaccggttcctgggcgtgatcgacggccgcgcccgcgccggacgcaacggcgccagctggcaggtcgccaccgtgcgggcgctgcaggacggcggcctgagcaggcgtgcggcgctggccgagatgctgcgccggtactgcgagcacatgcacgccaacgagccggtgcacacctgggagtagcttgggaaccatgtcgtctgatcaagtgatggactgggacagcgcctatcgcgaacaggcccacttcgagggcccgccgccgtggaacatcggtgagccgcaaccggaactggccgccctgatcgagcagggcaagttccgcagcgacgtgctggacgccggctgcggattcgccgagctgtccctggcgctggccgcccgcggctacaccgtggtcggcatcgacctgacccccaccgccgtcgcggcggccacccgcgcggcggccgagcgcgggctgaccacggccagcttcgtgcaggccgacatcacgtcgttcaccggctatgacggacggttcgccacggtggtcgacagcacgctgtttcactcgctgccggtcgagggccgcgacggctacctgcgctcgatccaccgggcggcggcagccggcgccagcttgttcatcctggtgttcgccaagggcgccttccccgccgagatgcaacccaagcccaacgaggtcgacgaagacgagctgcgcgccgcggtgggcaaatactgggcgatcgacgatatccgcccgtcgttcatcgtctcgaacgttccccaaatcgccgatgcgcctttcgaattcccggcgcatgagcgcgacgagaggggccggatgaagatgcccgcgtacctgctgaccgcgcacaaggcccagtagccctcaggccgaggtcgccgccgtcgcggcgatgagcgcttcggcgaaggtctccaggtcctcggcggtggtgtccaggtgcggcgagatccgcaacaccggcgcggtgagccgcaacggcgcgcgctgcacgccgacgaaggtggtcaggatccgccgctcggcgagcaaccagtcccgcaccgcccgcgggtctgcgccgtcggtgggcgccaaagtggtgatggcactgggctcttcggcgtcttcgacgaccgcccagccggtcacgtcggtcagcacgccgcggctcaggccgcccagctcggccagccgcgcgcagacggcggccggcccgtaccccaggtattcgcccagcgccagcgaaaaccccactcgcgcagcgatattggcctcaccgaactcgagttgctgagccaccgtggagcccggcgcccagtccggcgccgccagcctcgggtgcaggttttccatcagctcccggcgcaccgcgagcatcccgactccgcgcggccccgcgatccacttccgcgacgacgagtaggtcacgtcggcgccggccgtgcagtccacctgacccagcgcctgcgccgcgtcgacgaccagcggcagccccagctcccggcagagccgggcgatcatcgaaaccggttgcgccacaccgctgtggctgccaatcgtggtcaggtggaccaggtccggcgggtcggtctgcagggccagcgccgcgtcgtccagcgccacccggccgtcggccagggtcggcagcagccaacggtcgaatccgtgggcggtcatcacggccaggttggggccgtactcgccgggcaggcaggccagggtgcggcgctcggccggccagctgcccagcagcaggtccagggcgtgcagcgagccggtggtgaacaccgcctcggcgtcggtcatgccggtcagcgcggtgaatgcgaaccgcccggcgtcgagcaccggtgcggccgcctcggcggccacgtagccgccgagctcggcctcgttgcgggcgtgctgggcggtggcctcgatcaccgcgaagctctgccgggaacaggccgcgctgtcgaggtgcagacccgccgccggcggccgggccgaccgccacgtgtcggccagcggggtgccgccgctcacttgacggccaacgacaacccgaagtcctccgcgccgtcggtccaccaacgggtgcgacgcaatccggcggcggccagctcggcactcacccgctccgggcggaacttgcacgacacctcggtgagcatctcctcacccgcccggaagtccaccgtcagcccgagcgcaccgacccgcacccgctggcgcacggtcgcgcgcagccacatctcgatgcgttcctcgtccgcgttccagcgggccacgtgctcgaaggcgtcgacgtcgaaatccgcgtccagttcccggtttatcaccgcgagcacgttgcggttgaacgccgccgtcaccccggcggcgtcgtcgtaggcgcgcaccagccgctcggtgtccttgaccaggtcggtgcccagcaacaggctgtcgccgggccgcatctgggccgacagcgcggccaggaactgcgcgcgcggcccgggcgtcaggttgccgatcgtcgagcccagaaacacgaacagccgtcgcccgccttcggggatctcggtcaggtgctcctcgaaatcgccgcagacggcctggatttcgatgccggcgtattcgcgctggatggcggcggcggatgccgacaggatgccggcgtcgacgtcgaacgggacgtacctgcgcagcgcgccccgctcgcgcagcgcgtcgagcagcacccgggtcttctccgaggtgccgctgcccaattcgaccagggtgtcggcctcgctggccgaggcgatgccgggcgcctgcgcgcgcaggatctcggcctcggcgcgggtcggatagtattccggcaggcgggtgatctggtcgaacaggtcactacccaccgaatcgtagaaccacttgggcggcaacgacttcggtgtacgccgcagcccgtcgagcacgtcgcggcgcaacgcgtggtgggccgagtcggcggcgaggtggttggacagcgacagcgtcatcaaaatcccttcggatgatccagcggtgtcagcgtgacaccgtcggccgtgacatcgaccaggtggcggtccggcacgtcctcccagtcggagtcgtcgtcgtagggttcactggccaccaccacaccgtcggcgcggcgcaggatggacagggtgtccccccaggccgtggccagcagccgagaaccgttggcggccagtatgttaagccgggccgccgggtcggccgcgccgatctcgacgatcacctcgccgagtgcgtccaggccccgctccaagatgactgccgccaatatcgcgctgtcgcaaacggattcagcccgcgaggtcaccggcagcacagaccggtcgaccaccccgttgtgcgacagcagccaccggccgtcggtgaacggtgcggtggcgctgatctcgatcggcatgcccaccgtcgccgagcgcaccgcggccaccacgcagtggctgtgcagcgccggcgcgacggactcgaaggacacgtcaccccacagcggcgccgggctgcgccagcggcgcggcacctccgcgtcgaaaaaccctgcgccccaaccgtcggcgttgagcaggccgtgtttctgccggcgcggcgcgtaggactgcacccgcagcccgaacggcggctcgagcatcagcgaggagaccgtggcgtcggcccccagccatcccagatgccggcacatcagcggtggtcccgcgcgccaggcacgtcccaggccaaccggacaccggcgaagatctggcgccggtacgggtgatcccagttgcggaagctgggccgcaggatgcccggctccaccgcccacgagccgccgcgcagcacccggtagtcgccatcaaagaacggctgcgaatagcgttcgtagagcatcggcgcgaagcccggccagggccgcagcggggacgtcgtccactcccacacgtcgccgagcatctgttcggccccgcacgccgaggcgccggccgggtaggcgccgacgggggcggggcgcagcgcggcgccgcccaggttcgccacggccggcgatggcggcgtcgctccccacgggtagcggcgccgggtgccggtggacggatcccacacgcaggccttctcccactccatctcggtgggcagccgggcaccggcccaggccgcgtacgcctcggcctcgaaaaagctgacgtgctgcaccggttcgtcggccgggatgtcttcgacatggccgaaccgggtgcgggtgcgcgcgtcggggtgccagaactggggcgccgtcaggcccgcggcctggcggtgctgccagccgcgccgcgaccaccaccgcggctcgtcgtagccgccgtcggcgacgaactgctgccattcgccgttggtcaccggaaccgtgccgatccggaacgcgggcaggtcgagcacgtgcgcccggcgttcgttgtccagcgactcgggttcgtcggcggcgtccaccccgaggacgaactcgccgccgggcaccagcaccgaggtgccggccagttcgggccggccggccggcagcaccgacgtgtcgcgcagcagcggcgcgccgctgcgcaggttcagcgcctgcagcatggtttcgtcgtgctggttctcgtggctgaccaccatcgcgtacacgaaggcggcgtcggggtcgtcgggcaacgcatccagggtgtcgagcaccgccgcgcgcaccgtgcggcagtaggcgcgggcctgctccggcgacagcagcggcaggtcgacccggctggcgcgggagtgcacgaacgcgtcatagaggccctcgacagccggcggcaacatcccgggccgggcggggtcgccgccccgcaacagccacagctcctcctgctggccgatgtgcgcgagatcccacaccagcgggctcatcaacgggtcgtactgccggcgcagctcgtcgtcgtcgaagtcgaccagccgcagcgtccgcgcccgcgtccgcgccagctggtcggcgatcgcctccggtgacgtcacggccccccttgcgggccgcgcgcggcccgggaaaccgacgccgcgatgccgtgctcgatgacctggtcggcgaagtcgtcgccgggacaccggccctgttcgacgaggcggaccagccgccgcatcggctcggcgagttcggccggcgcccgctcggcggcgatcgccaggcaggcgttggccgccgcgtacagccgtcggtcccgcagccccacccgggccgcgacgtcccaggcggtggccaccggttccacggcccgggccgccaggccggcggcgaccgggtcgtcgagcagcgcgaccagggtgaacaccacggcgggccacagggtgtcgggcacgctgtccaggtagcggatctccagccactgccgcgggcgcaccggcgggaacagcgtggtcaggtggtactccaggtcggcgacagtgggccggcggccgcccagcagcacccgcccgtccacccagtcggcgaacggcacccagcgcgtgaccgcctcggcgtccggggtgtgcaccaacatcaccggggccttgagcgcgtagcgcgcccagtcggtgcccgggtcgtcgccgctggcgcccaggactgggccgcagcgcgccgagtccatccgcccccacacccgctgccggctggacacccagccggtgaaatcgccgtccagcatcggcgagttggccgtcatcgcaatcatggtggggcccaaggcatgtgccagccgcacccgcgccgcccagccttcccgcggcccggcgtccacgttgacctgaatcgacgccgtggatgtcatcattgccgcgcccgcctcgccggagcggctggtggcgaagaaccgttccatggcgcggtagcgggcgccggggttgatccgctggggcggccgcagcgggtcggcgcccaaaaacaccagacccagcccggccccggcgaatgcgggccgcagcacggcctggtcgcggcgcatggcgtcgatggccgccagcacgccgtcggccggcgggccggacagctcgacggccccgcccggctccaccgtgacccggctgccgccgggcagcgcgggcagcgcgtcgagcaccgcggcgatctcgtcccagcccggacggcggcacgggtcttgcgggtcgtggcagtgggcttcgacttccagacccacccggcccagtggagcgtccgccagacagccccgggcgatgtactgcgcgacggccgcggagtcggtcagctcggcgatcctcagctcggccgccgggtcgccaccggccggccgcgaagccgccgcagtgctcggggcgaacgtcatatcacgatcccttcgggcccgaccaagcctgaacatgcacctgcggaccgcttccctgcgcagctaatcgaacgataaccggcaccacttcgtctagtgcttcatctatcagacgcccccgacatattcccctcgcgcgccttcggctcgccttcgcggcgcggcgtcgagggcgcacggaaacgacgggtacccgatccgtcgactattgacccagcgcgttttgcatggcccccgcgagcacgttcaccgcgggcccggcattgccggactggcacactttcgcctgcagcaccacgttttcacgcagcctggtctgattgaagcaccggcgatcggtgccggcttcctgcttggtccagttctcgtcggcgggaccggccggcccgccgtcgaacgaccacacctgggtgctgccgttgtccaggtggatcgcggtggtctgacccgaacagcccaccgttcgatccaccacccggtgaaaggcgcggtccgcggcgtcgttggtggcgaacaccccgaccgcctgtttgaccagatgcgtctggtcggtcgccgaggtctgggtgacggccccgttgaacgacgccaggtcggggtcgttgaacacctcgggcaagccgatgtcggcccagttgttgcactccggcaggtccacccagtcgccctgcccgggctgagtgaacaccgactcccaccccatgggcccgccgacgatgttgccgaccgaccccttgcccagcacggcgtagttcaccacgccgggctccgacgggtgggcggccgcgaccggcagcgcgaccgcgcccacggccgcgacgccgacgaacaacaccgcccggcgaacccgcgtgatccgcatggtcatgcagcgatcatgccaggcgcccccggccttgaggacccggctcaagggcccggctcgagggagcggcttaagggcgcggcgcgggcgtgctgggagcggggctgaccggcgacggctgcccggggccgctgacgcccgggccggagaccgggccgccggggccacccgggccgccggggggcatcgggacgatcaatcccggcccgccgggccagggcccgttgtcgggtccacccgggccgccgtaccacgccccggaaccgccgggaccgccgggccagggcccgttgcccggtcccggaccgccgtactgccagggcccgttgcccggtccggggccgcccggatgaaagacgccgtggtgatggtggcagtggtagtagctgtgcttccagatgaaggcgccgacgaagaacaccgacgagatgatgaacacgatgcccgcgacgatcaccacccaggccgccgccgtgtagagccgcggcggcttcacccgctcgggcggcggcgggggcggtggaactgcggcggctggggtcggctcgggagtggtcggctcagcttgcggttcgggtgtctcgctcatgccatgccatattgccgcgcgcgccaggcacccaacagggccccgcggcaaattgttgcgaatcgagacgcggcggttaccccgacgaacgggtggcccggcactcgcacggagcgccgggccacgggttgggtatcgggtttcagttggtcaggacgatgacgctcggggcctgccccagcgcgccgtgcgacgtcgccgcggagtggaagaccgacgccggcagctggttcggggccaggccgctggggcgcaccggcgacggcgcggccggcgcggtggacgtgcccggaccggtctggccgccctggccgccgggtccgcccgggccgccgaagctgccgggaccacccgggccgccggggccgcggtgatgcatcatcgcgtggtgcttgtggtggtggtggccgtgatggccgccgcggtggccgaggatgaagccggtgaagaagatcaccgcgacgatgaacacgatgccggcgacgatggcgacccacgcggcgacttggaagacccgcggggtccggtatggcgccgcggcagcgggcgccggtgcagtggcggtggaggtccgcacagtgggggtttcagatgtttcactcatgagacaaatgatgaaggcgttaacaatagctgcggctatgcgccggttatgtagcagctgtgaaccaaagcccctgctcagcaaggcatatcgccgaccccgagatttcgaggttagggcttcaaccttgaaaactaggggccgaatttcaaggttggcccggcttgaacgggttcaccgcgaactggatgacccggtagggagcggccacccgcgcgcgggtgtcccactggctcacgaagatccgcagctcgtcgagcgtggagccgggcgagatgtagccgccgtagggctgcgcgagccggttgtcgtagggcggcggcaggctttccgccggctcgggccactcgtcgtgctgcaccaccgtggtgaccggcgcgtcacccagcatccgcgggtcgtcggcgacccggacctccatgttgcccgtggtggcattgaaataactcagcacggccttgccgtcgatctgccggatgcacatctcgcccaccgcgtccggccacagcggggtcggcggcttgccccacccgccttgcggtccggccgcccagccctgccaccgggaccggtcggtgaaggcctgcggggtcacccggtacagcacgaccggatcccggcgggtgaaactgtcggccacgatgtacacccagccgctcggcgattcctcggtgggtatcgggtcgtaatagccgctgatctgggtctgcgagccgccctgatacgaggcgggccgcgtggaccccgggatcgtctgccagcccgcccgcaccggttcggcggtcaccagccgggagctttgcggctcaaggtttttcgtggtcgtcaccatcaggtagttgcgccggttgatctgcaccaccccggcgggcagctgcgaggcgccaggcggggcggggtcggccagcagcgggttgctgatcccggtgacgccggtgtagcgcaccccggccgggtcgtcgacggacgcggtgtcgacgcgcagggccaccggcgcataccagccgccgaatccgacgccctggcccgcgaagctgtcgccgcacacctgcagcagttcggtgggaaattccacgaactcacacaggtcggtggcgccgatcccgtaatcgcctgtgggagtgccggttccggcggtggggccgatgcgcagcacctggccgggcgccagcgggcccacgatgggttccggttcgggcgccggcgggtcggcgcgtgccgcggtaaaccattgcggcgcaagcaaagtcaatgcaagcgaacaccgcgcgaccagtcgagtgtgcgcggcgctcacccgcgcctcacaactgagcggccagcagctcggcaatctggatggtgttcagcgccgcgcccttgcgcaggttgtcaccggagatgaacagggccaggccgcgcccgtcgggcacccccgggtcgcgccggatccggccgaccagggattcgtcgaccccggcggccgccagcggggtcggcacgtcgaccaccttgaccccgggcgcgccgtcgagcagctcgcgggcccgctccggggacaggggccgggcgaattcggcgttgatcgacagcgagtgcccggtgaacaccggcacccgcacgcaggtcccgctgaccgccaggtcggggatgcccaggattttgcggctctcgtgccgcagcttctggtcctcgtcggtctcgccggagccgtcgtcgaccagcgacccggccagcggcaccacgttgaaggcgatcggcgcgacgtaggtctggggcgccgggaacgacaccgcgcgcccgtcgtgcaccagctgctcggcgccgtcgatgaccgcgcgcgcctgggtggccagctcctcgaccccggcgatcccgctgccggacaccgcctggtagctggacaccaccaggcgttgcagcccggcctcgtcgtgcagcaccttgagcaccggcatggcggccatggtggtgcagttcgggttggcgatgatgcccttggggcgacggtgcgcgtccctctcgaagttcacctcggacaccaccagcggcacgtcggggtccttgcgccacgccgacgagttgtcgatcaccgtcaccccggccgcggcgaaccgcggcgcctgcaccagcgacatcgtcttgccggcggagaacagcgcgatgtccagacctgtcgggtcggccgtcgcggcgtcctcgacctcgatctcggcgccccggaattccagcttgcgaccctgcgagcgcgacgacgcgaagaaccgcaccgaggtcgccgggaagtcgcgctcgtcgagcagccggcgcatcacctggccgacctggccggtggcgccaacaactccaatagcaaccatctatctgcccgtccccgcatacaccgtggcggtctccgcgccgccgagcccgaacgcctcgtgcaacgccacgacggccttgtccagttccgtgtcgcggcacagcaccgagatccggatctcggaggtggagatcagctcgatgttgacgcccacctgcgccagcgcctcacagaaggtggcggtgacgcccgggtggctgcgcatgccggccccgatcagcgacaccttgccgatgtggtcgtcgtagagcaactgggtgaacccgatctcgtccttcagcgcgtccagcttggccaccgcggtgggcccggcctcgcgcgagcaggtgaaggtgatgtcggtcttgccgtcctcgaccttggagacgttctgcagcaccatgtcgatgttgacgtcggcgtcggcgacggcgcggaacacccgcgccgcatagccgggaatgtcggggatgccgacgacggtcaccttggcctcgctgcggtcgtgcgcgactccggtcaggatggggtcttccatgggcttgtccttgatcgatccgacgacgacggtgccttccttgtccgagtacgaggaccggacatgcaccggaatgttgtagcggcgggcatattccacgcagcgcagcatcaagaccttggcgccgcaagccgccatctcgagcatctcctcgaaggtcaccgtgtccagcttgcgggcgttgtgcacgatcctggggtccgcggagaagatgccgtcgacgtcggtgtagatctcgcagacgtcggcgcccagcgccgcggccagggcgacggccgtggtgtccgagccgccgcggcccagcgtggtgacgtcccgggtgtcctggctgacgccctggaacccggccaccagcacgatccggccctcgtccagcgcggcctgcagccgtcccggcgtgacgtcgatgatcttggcgttgccgtgcgtgccggtggtgatcaccccggcctgcgagccggtgaacgaacgcgcctgggcgcccagcgactcgatcgccatcgccaccagcgcgttggagatccgctcgccggcggtcagcagcatgtccagttcgcgcggcggcggggccggacacacctgctgggccaggtccatcaggtcgtcggtggtgtcgcccatcgcggagacgacgaccaccacgtcgttgccctgcttcttggtggcgacgatgcgctcggccacgcgccggatccgatcggcgttggccaccgaggatccgccgtacttctgcacgacgagcgccacctttttcctgcctctccgggcctgcgcactggtatttcgggaataagtccacaacagaatacgtgcccccgcatggtgatttacgtcgcgataccgggtggcccggcctgcgcgggcgccgcggtcccggcggcattttcgccacggcgccaatcgcggtaaagttgccgacgtgcagcgggtgctcctcctcggacgccgcgacggggtctgattccagaccggcttcccgtcgcgggtgttcgcgatgcgccggtctgaggttccttctgatatccccggagcaatcaccgtgacttcccatcccgacgccttcagctcgtcccgcagcatcgtcaaacccgccggcccgcccggccccggacagcccgcctggaacccccagcgcggctcctcgatgccggtcaaccggtaccggccgttcgccgaggaggtcgagcccatccggctgcccgaccgcacctggcccgacaaggtcatcgaccgtgccccgctgtggtgcgcggtggacctgcgcgacggcaaccaggcgctgatcgacccgatgagcccggcccgcaagcgccgcatgttcgacctgctggtccgcatgggctacaaggagatcgaggtcggcttcccgtcggccagccagaccgatttcgacttcgtccgcgagatcatcaccgagggcgccattcccgacgacgtcaccattcaggtgctgacccagtgccggccggaactgatcgagcgcaccttcgccgcgtgccagggcgcgccgcaggccatcgtgcacttctacaactcgacgtcaatcctgcagcggcgcgtggtatttcgcgccgaccgggccgcggtgcaggagatcgccgtggccggcgcccgcaagtgcgtcgaggaggccgccaagtaccccgagacgcagtggcggttcgagtactcgccggagtcctacaccggaaccgaactggagtacgccaagcaggtgtgcgacgcggtcggcgaaatcataaggcccacaacggaaaacccgatcatcttcaacctgcccgccacggtggagatggccacccccaacgtgtacgccgactccatcgagtggatgagccgcaatctggcccgccgcgactccgtcatcctgagcctgcacccgcacaacgaccgcggaaccgccgtcgccgcagcggaattgggctatgcggccggcgccgaccggatcgagggctgcctgttcggcaacggcgaacgcaccggcaacgtgtgcctggtgacgctggggctgaacctgttctcccgcggcgtggacccgcagatcgacttctccaacatcgacgagatccgccgcacggtggagtactgcaatcagctgccggtgcacgagcggcacccctacggcggcgacctggtctacaccgcgttctccggcagccaccaggacgccatcaacaagggcctggaccagatgaagatcgacgccgacgccgccgacaccgacgtcgaggacatgctctggcaggtgccgtatctgccgatcgaccccaaggacgtcgggcgcacctacgaggcggtgatccgggtgaactcgcagtccggcaagggcggggtggcctacatcatgaaggccgatcacggcctggccctgccgcgccggctgcagatcgagttctcccaggtgatccagaagatcagcgagggcgagggcggcgaggtcagccccaaggagatgtgggacgcgttcttcgaggagtacctggccccggtgtggccgctggagcgggtcaagcagcgcgtcgacgcctccgacgaggacagcggcgtcaccagcatctccgcgacggtcaagatcaacggggagcagaccgagatcaacgggaccggcaacggcccgctggccgcgttcgtgcacgcgctcgccggggtcgggttcgacgtggcggtgctggactactccgagcacgccatgagttcgggcgacgacgcgcaggccgccgcgtatgtggaggcgtcggtcaacggtcggacggtgtggggtgtcggcatcgccccgtccatcaccaccgcctcgttgcgcgcggtggtgtcggcggtcaaccgcgccgcccgcgcctgatcagaacaacgccagctgcggatcgggcgtggcgtcggtgaactcgtccatgctggtgccgccgatgacggcgcgaacgcagtccaaaaactgcgcgtcggagatcaccggcacccccaattgccgggccagatagcctttgccgtgctcggcggcggggtcgttgcacaccaccagcgaggtctcccggtccacggtgtcgctgtaggccagcccggcgtgcaggatccgctcgacgagttcctcgtgcgtgcgctcgacctcggcggccagcgcgacgcgcatgccctggacgagtggtcggccgcccacgtaggggcccgggttgagataggggcagggcatccgggaggccagcaccttcagcgggcgcagctcgtcgtgggtgacccggccgttgggccagcggcgccgggtcaccggatgcaccggcagccagatgtcgcgttcccgggcccgctgcagcgccgaggccagcacgccggtcagcaccatggcgtcgtcgaaggcgtcgtgcggccgctgctgggtcacgccccagtgcgccgccagcgtctccagccgcaggttgtcgatgcccaggtccagccgccgggccagctcgaccgtgcacatcacggtgtcgacgggaagttcgatgccggcgagttcggcctcggcggcgaggaaggcgtagtcgaaggccacgttgtgggcgaccagggtgcggccgcgcagcacctcgaccacgtcgcccgcgatgtcggcgaactgcggctggtcttccagcatggcggcggtcaggccgtgcacgtgggtggggcccggatccacgcccgggttgagcaggctcaccaccgactgctcgaccttgccgccggcgtccagcccgagcaccgcaaggctgatgatgcgagcctgacccgggcgaaagcccgaggtctcgacgtcgatgacggcccatcccgcgtccggctcgctggccggacgaccccagcacaccgcgctcatgcactgaggatggcacgggcgaccgacatcaccggtgtcccacggcgccgtgtcggcgttcgaatcgatccgggcgacccgctgcgcccggcgacaagcgccgcgcttgcgatcgcacggaacccgatgagggcgacccgctgcgcccggcgacaagcgccgcgcttgcgatcgcaccgaactcgatgagggcgacccgctgcgcccggcgacaagcgccgcgcttgcgatcgcccttaaactctccgggtgctgaccacccgtgcccgcctggccctggccgcgggagcgagcgcgcgctgggcgtcccgggtgaccggccgcggcgccggcgccatgatcggcgggctggtcgcgatgacgctggaccgctcggtgctgcggcaactggccaccggccggcgcaccgtcgtcgtcaccggcaccaacggcaagtcgaccaccacccggatgaccgccgccgcgctggccaccatgggatcggtggccaccaacgccgagggcgccaacatcccgccggcctggtcgcggcgctggccgccaaccgcggcgcccggctggccgccctggaggtcgacgagatgcacgtgccacacgtgtccgacgccgtccgcccgggcgtcgtcgtgctgctcaacctgtcccgcgaccagctggaccgggtcggcgagatcaacgtcatcgagcggaccctgcgcgccggcctggcccggcacccggacgcggtcgtcgtggccaactgcgacgacgtgctgatgacctccgcggcctacgacagcccccacgtggtgtgggtggccgccggcggctcctgggcgaacgattcggtgagctgcccgcgcagcggcgaggtgatcgtccgcgagcaggggcattggtattccaccggcgccgacttcaagcggcccagcccgcactggtggttcgacccacaggacggcggcaacctgtacggccccggcggtgtggcgctgccgatgcggttggcgctaccgggcgcggtgaaccgcggcaacgccgcccaggccgtggccgccgcggtcgcgttgggcgccgatccggcggcggcggtgacggccgtgtcgacggtcgacgaggtcgccggccggtatcgcacggtgcgggtcggcgggcacgacgtccggatgctgctggccaagaatccggcgggctggcaggaagcgctgtcgatggtggacccgcacgccgacggggtggtcatctcggtcaacggccgggtgcccgacggcgaggacctgtcctggctgtgggacgtgcgcttcgagcacttcaacgacgcgttccagaccaccccggtggtggccgccggggagcgcggcaccgacctggcggtgcggctcgggtacgcgggtgtcgagcacaccctggtgcacgacaccgtcgccgccatcgagtcctgcccgcccgggcgggtggaggtcgtcgccaactacaccgcgttcctggcgctgcaacgagcggtggcgcgccatggctgattcggtcgtgcggatcgggctggtgctgcccgacgtgatgggcacctacggcgacggcggcaacgcgctggtgctgcgacagcgactgcggctgcgcggcatcgacgccgagatcgttgagctcacgctggccgacccggtgcccgagtcgttggacctctacacgctgggcggggccgaggactacgcgcagcggctcgccacccggcacctgctgcgctacccgggcctgcagcgcgccgccgaacgcggcgcgccggtgctggcgatctgcgcggccgttcaggtgctcgggcactggtatgagacgtcggccggggggaacgggtcgacggcgtgggcatgctggacgcgacgacctccccgcaggacgcccgccacatcggcgagctggtgaccaagccgctgctggccggcttgaccgagccgttgaccggtttcgaaaaccacaggggcggaacggtattgggcccctccgccgctcccctgggcgcggtagtcaagggtgcgggcaaccgcgccggagacggtttcgacggggtagtgcaggggtcggtggtcgccacctacatgcacgggccgtgcctggcccgcaacccgcagctggccgacctgctgctgcgcaaggtggtcggcgggctgcccgagctgccaatgcccgaggtggagttgctgcgccgggagcggctggccgcccgctgagcggccgaaaaccctcagaccatggcgcggcggccggccagcgcgcggcccagcgtcaactcgtcggcgaactccagatcgccgcccatcggcagcccggaggcgatgcgggtcacggtcaggccgggaatgtcgcgcagcatccgcaccaggtaggtggccgtcgcctcgccctcggtgttcgggtcggtggcgatgatcacctcggtgatgtcgacgtcgtcgacccgctccccgatccggctgagcagctcgcggatccgcagctgatcggggcccaccccggacaacggatcgagcgcaccgcccaaaacgtgatagcggccgcggaattcgcgggtgcgctcgacggcctgcacgtccttgggctcctcgaccacgcacaccaccgacgcgtcgcggcgggggtcggagcaaatccggcagcgctcgtcgtcggagacgttgccgcacaccgcgcagaaccgcaccccgtcgcggaccctggccagcaccgcggtcagccggtcgatgtcgggcggttcgaccgatagcagatgaaaggcgatgcgctgggcgcttttgggcccgatgcccggcagcttgcccagctcgtcgatcaggtcctggacgggtccctcaaacatgtcggccctggaatctacccggacgctaaacgcccggcgccggtgccggaggctgcccgggcggcgcgccgaacccgccggccagcgacccgagccgctcctgggccatccgggtgacctgcttggacgcgtcggccatggcgccgacgaccaggtcctgcagggtctcgacgtccgacgggtcgacgacggagggatcgatcttgaccgcgaccacctcgccgctgcccttgacgacgaccttgaccagacccccgccggcctgaccgtgcacctcggcgttggccagttgctgctgggcctccatgagcttttgctgcatctgctgcgcctgggccagcagcgcggacatatcgcctccgggtccgggttgcatgacagtcccctcgcgtcttggtctcgacttggtttcgctcgtgagtctccggcgattcggaacacccagcgtagaccgcgcgacgttaccttggcgccgtggacctacgactgagcagacgtgtcgggatcaaagtggcggtcggtgcgctggttgctgcgtcgacggcgatcattccgaccgcggccccggccgcgtggggggtgccgtccaacatcgccggcatggtggtgttcatcgacccgggccacaacggctccaacgacgcgtccatcaaccgccaggtgcccaccgggcgcggcggcaccaaggactgtcaggccagcgggacggcgaccaacaccggctaccaggagcacaccttcacctgggacaccgcgcttcgggtgcgcgccgagctgaccgcgctgggggtgcgcacggccctggcccgggccaacgacaccgggctgggcccctgcgtcgatgagcgcgccaacatggccaacgcgttgcaccccaacgcgattctgtccattcacgccgatggcggaccgccgtcgggccgcggcttccacgtcaactattcggccccgccgctcaaccaggtgcaggccgggccgtcggtgcaatacgcccgaatcatgcgcgatcagatgcaggcctcgggcatcccgccggccaactacatcggccagaacgggctatacgggcgctcggacctgaccggcctgaacctggcgcagtacccgtcgatcctggtcgagtgcggcaacatgaagaaccccgcggattcggcgctgatggagtcggccgagggccggcagaagtacgccgacgcgatggtccgcggcgtcgcgggcttcctgggctcccagggccaggcccgctagctctccagctccctcttcaggttggccagcacctcgccctgaatcttcttcagccccaacggcgcaaaggttttctcgaagaagcccttgacgccgccggcgccggtccaggtggtcttgacggtgacgctggagccgggcccggccggtgccaccgtccagttggtcaccatggacgaattggcgtccttctcgatcacggtgtgcccggccacgtcgacgtcgacctgcacgtcgcggacccgcgacttggtggcttgcagcttccacttggcgaccgtgccggcgccctgcccgccctgcagcacctggtagtcgctgtattgcggggagatgattttcgggcggaccgtctggtagtccgcgacggcggcaagggttgccgccgggtcggcgttgatcaagatggtgctgtctgcgctcacctgtcccacggcggcccctcctgctgatggtttccccgataccgccgctcacgacgggtgcacgggctgttgtcgaagactagggtatatctggtgccagtccttggatccgcactctcggcccaccaggccggcgtcgaccggttgctggaaagttatcggtccatcccggcaacgtcggccgtccggctggccaagccgacgtcaaacctgttccgcgcccgcaccaaacgcgacgcgcccggcctggacacctccgggctgaccggggtgctgggggtggatccggagacccgcaccgccgacgtggcgggcatgtgcacctatgccgacctggtggccgcgaccctgccgtacgggttgtcgccgctggtggtgccccagctcaagacgatcaccctcggcggcgcggtcagcggcctgggcatcgaatcggcgtcgttccgcaacggtctgccgcacgagtcggtgctggagatggacatcctcaccggcgccggcgaattgctcaccgcgtctcgcacccagcacgccgacctgttccgcgccttcccgaattcctatggcacgcttgggtattcgacccggctgcggatcgagctggagccggtcgcgccgtttgtggcgttgcgccacatcaggtttcacgcactggctgacctgatcgcggcggccgaacgcatcatcgataccggcggccacgccggcacgccggtggactatctcgacggcgtggtgttcagcgccgacgagagctacctgtgcgtgggccggcggaccaccacccccggcccggtgagcgactacaccgggcaacacatctactaccagtcgatccggcacgactccccgggcgacgagcccaccaaggacgaccggctgaccatgcacgactacttctggcgctgggacaccgactggttctggtgctcgcgtgcgttcggcgtgcagaacccgcgggtgcggcgctggtggccgcgccgctatcggcgcagcagcgtctactccaagctggtctcgctggaccggcgcttgcgcatctcggaccgcatcgaggcccgcaacggccgtccgccgcgcgagcgggtggtgcaggacgtcgagctgccggtggaacggaccttcgaattcctggagtggttcctcgaaacggtgcccatcaccccgatctggttgtgccccttgcggttacgcgaccatgacggctggccgctgtacccgatgcgcccggatcacacctatgtcaacgtcggcttctggtcgtcggtgcccgccggtgcgaccgagggcgccaccaaccggctgatcgaagccaaggtgagcgagctggacgggcataagtcgctgtactccgactccttctacacccgcgaggagttcgacgagctctacggcggcgaggcgtacaacaccgtcaagaagacctacgaccccgattctcgtttactcgacctctacgcgaaggcggtacaacggcgatgacgaccaccaaacaaccgcaccggtcgcggaccggcaagctcagcatggccgagattctggaggtcttcgccgcgaccggccgccacccgctgaagttcaccgcgtacgacggcagcaccgccggcagcgaagacgccgagctgggcctggatctgcgcagtccgcgcggggccacgtatctggcgacggcgccgggcgagctcggcctggcccgcgcctacgtggccggcgacctgcaggcctacggcgtgcatccgggtgatccgtaccggctgctcaagacgctgaccgatcgggtgcagttcaagcggccgccggcccgggtgctggccaacgtcgtccgctcgatcgggttcgagcggttgttgccggtggccccgccgccgcaggagacgcgcccccggtggcgccggatcgccgacgggctgatgcacaccaaggcccgcgacgccgaggccatccaccaccactacgacgtctccaaccggttctacgaattggtgctgggcccgtcgatgacctacacctgcgcggtgtacccgcaccccgacgcgacgctggaagaggcccaggagaacaagtaccggctgatcttcgacaagttgcggttggccccgggcgaccggctgctcgacgtcggctgcggctggggcggcatggtgcgctacgcggcgcgccgcggggtgcgggcgatcggcgccaccctgtcggccgagcaggcgaagtgggcgcagcgccgcatcgacgacgaggggctcggcgacctggcgcaggtgcgccactccgactaccgcgacgtcgcggaaaccggtttcgacgcggtgtcctcgatcgggttgaccgagcacatcggcgtcaagaactaccccgcctacttcgggttcctgaagagcaagctgcgcaccggcggtctgctgctcaaccactgcatcacccggcacgacaacacctcgacgtcgttcgccggcgggttcaccgatcgctacgtgttcccggacggcgagctgaccgggtcgggccgcatcacctgcgcgatccaggacgtcggcttcgaggtgctgcacggcgagaacttccggcaccactacgcgatgacgctgcgcgactggtgccgcaatctggtcgagcactgggacgccgccgtcgacgaggtcgggttgccgaccgcgaaggtgtggggtctgtacatggcggcctcgcgagttgccttcgagcagaacaaccttcagctgcatcacgtgctggcggcgaacgtcgacgcgcgcggcgacgacgacctgccgctgcggccgtggtggtcgccctaacagggaggtgctcagcccccgtcgatgcggcgggcgcccaactcgttctgcagcagctccagcgcggcctcttccgggtcgcggcgcgccgccggctcgtcgcgcaccgcctcggccagcatgtgctcttcctcgtcacgccgggccgaatccggttcggggacgggctgttccggcttggggtgcggcgggccggccgtggccgacgccggtgagccggcctcacagcgcacccgccagttgacgcccagcgcatccttgagcgcctcggcgatgacgtcggcgttgcgctgttcgcagagccgcttggccaggggtgccgattcatgcgtgagcaccagcgtgttgtcctcgatcgcccgaacggtggcgccggccagcatcacctcggtggtgcggctgcgctgacggaccttgtcgcgcaccgtcgaccacatgcttcgcaccgcggcggcattgagttcccctggcgcggacggggtttcggaggcccgcgccggctccggcgccggcttgggctccggcgtgggtttggccctcggctccggcctggcctcgggctggggttccggctcgtgctcgggcttggccgccgccggctcgggcttggacgccggcttgggcgccgcggacggccgggtgaaccgcaccggctgctcgaccggctcggccggcgtcgaccccgcgggaatggacatgtccagccgggtctcgatccgctcgacccgttgcagcagcgccgattcggtgtcgctggccgagggcagcaacagccgggcgcacaccacctcgagcagcagccgcggcgccgtcgcaccccgcatctcgcccagccccgcctgcaccacctcggcgtaacgggtcagggtcgccgggccgatccgggtggcctggtcacgcatccgctccagcacgtcctcgggagcgtccaccacgccgcggctggccgcatcggggacggcctgcagcaggatcaggtcgcggaaccgctcgagcaggtcggtggcgaagcgccgcggatcatgcccggcgtcgatcaccgactccaccgcgccgaacagcgccgcggcgtcgccggccgccagggcgtccacggcgtcgtcgatcagcgccaggtcggtggccccgagcaggcccagcgcccgctggtaggtgacgtgcccgccctcggcgcccgcgaccaactggtccagcaccgagagcgtgtcacgtggcgagccgccgccggcgcggatcaccagcgggtacaccgcgtcgtcgacgacgacgccctcttgttcgcagatccgcccgatcagcgcccgcatggtcttgggcggcagcagccggaacgggtagtgatgggtgcgcgaccggatcgtcggcagcaccttctccggttcggtggtggcgaagatgaagatgaggtgctcgggcggctcctcgacgatcttgagcagcgcgttgaaccccgcggtggtcaccatgtgcgcctcgtcgacgatgaacacccggtggcgcgactgcgccggcgcgtagaacgcccggtcgcgcagctcgcgggtgtcgtccacgccgccgtggctggccgcgtccagctcgaccacgtcgatgctgccgggcgcgttgggcgccagcgccaggcacgagtcgcacaccccgcacggcgtggccgtcggcccctgcacgcagttcagcgagcgggccaggatgcgcgccgaggaggtcttcccgcagccgcgcggacccgagaacaggtaggcgtggttgatccggccggcttccagcgcgatcgacaggggttcggtgacgtgctcctgccccaccacttcggcgaaggttgccggacggtacttgcggtagagggccacggtcagcaggctaccggggccggccgacgacgatgcgggcccgccagggtctgctgagaagtcggacaatcgggcagcgtccgacgacgatgcgggcccgccagggtctgcgtgcatcgagtgtgcggcagcggcttccagtgtgaatctacggcgggcccgcccggcgtgtcgtcgccgtcatgcaacagtcgaagccgtcagctcacacccgatcgcgagccagcagcgactccgaggccgccagcagcgcgcaggtggccaggccgtcgaccgcgtcgcgcagatcgggcagcgacgggaaggtgggcgcgatccggatgttggtgtcgttggggtctttccgatacgggaacgacgcacccgcctcggtgaccgcgatgccggcgtccttggccagggcgacggtccgcttggcggtgccgggcagcacgtcgaggctgatgaagtagccgcccttgggctcggtccacgaggcgatcttggagtcgctgagccgctggtcgaggatctcgagcgccagcgcgaatttcggcgccaggatctgctggtggcgcagcatgtgcagccgcaccccgtcggcgtcgcggaagaagcgcaggtgccgcagctggttgaccttgtccggcccgatcgacttcttgcccgcgtattgcaggtaccaggcgatgttgcccagcgagccgccgaagaagctcaccccggcgccggcgaaggtgatcttggaggtggacgcgaacacgtagggccggttcgggttgccggccgcggcggccagccccagcacgtcgacctgccggatgaagtcgtgcgtgagcgtgtgcaccgcgtacgcgttgtcccagaacagccggaagtcgggcgccgcggtgcgcatctggaccagccgcagcaccgtgtcccaggagtaggtgaccccggtggggttgccgaacaccggcaccgtccacatgcccttgatggcggggtcggcggcgaccagctcctcgatcaggccgacgtcggggccgtcggacagcatcgggacggggatcatctcgatgcccatcgtctcggtgatggcgaagtgccggtcgtagccggggaccgggcacaggaacttgacgctcggttcgtccttccagggccgctgcgagtcgacgccgccgtagagcatggagaaggcgaccaggtcgtgcatcagctccaggctggagttgttgcccgcgatcaggttttgcaccgggatgccgagcagctcgccgaagatcgcgcgcagttccggcaggccgtgcaggccgccgtaattgcgggtgtcggtgccctcgctgtcgcggtagtcgtcgccgggcagggacagcagggcgttggacaggtcgagctgcgcgggcgccggtttgccgcgggtcaggtccagcgacagcttcttggcctgcaggtccgcgtagccctgctggtggcgggcgtgcacttcggcgagttcggcaggggtgagggactccagcgacaccatggctattgcgggccctttcgccgtccgaccgggtggaatccgtggcgatcgcaagcgcggcggagccgggcgaagcgggtcgccactcatcgaaggtaggggaccccgcgcacccgacagagcccgttgacccttgctgccttccggccctgggggagttcacaggatagacgccgcgcggggtccacccagagtctaatacccgacccggagcaactggcggcggcggtcgggcgctcggttaccatggccacggaggattcgcctagtggcctatggcgctcgcctggaacgcgggttgggttaatagccctcgcgggttcaaatcccgcatcctccgccattggtccgcccagcggacgcgcacaacgtgggccggctccagccggtcttgcatgaggaggcttatggggcgcaaggtcgccatcccgtggcacgcgtcattttcgatcgctgccggcgtcctctacttcttcttcgtgttgccccgctggcccgagctgatgggtgacacgacacattcgctggggacggcgctgcggatcgtggcgggtgtgctggtcgcgctggcggcgctgccggtggtgttcaccctgttgcgcacccgcaagcccgagctgggcacgccgcagctggcgttgtcgctgcgggtcgcctcgatcgtggcgcacgtgctggccgggttgttgatcatcgggacggcggtcagcgagatctggctgagcctggatgccgccggccggtggttgttcgggatttacggcgcggccgccgcgatcgcgctgctcggcattttcgcgttctacctctcgttcgtcgcggaactgccaccgccgccgcccaaaccgatcaaggccaagaagcccaagaagcgccggctgcgtcgcaagaaggccggcgaagaggcggagacggccgaaacggctgaagcggaagaggccgaggcggaagaggccgacgagaccgaagcggcgcagaccgtcacggccgaaaccgaagcagccgaagaggccggggaaaccgaagcagccgaagacaccgccgaggccgagaaacccgccgcaaccgagcccgaagccgagacgcccgtggccgaggacagcgacgaatcgcgggccaagctccgcaaccgccgcccgacgggcaagggcacgcaccggatgcggcgccggcgcacccgggccggcgtcgcggtcgaccaaaccgccgagcagtccggcgacgacgccgacgagaactagcgcgccaccgccagcagcaccggaatcggcgtgttctcgtcggtgtgataactcgcgcacacccggtgatagccgtcggcgatctgcaacgggacaccggccaggaagtcgccgcgcaccaacaggatcggcgacagcggtaggcccttctcgatcttggtgaggtccgcggcgacgtgcgggttgtccaccggcagcaggtccagccgcgccgcccgcagaatgtccttcgccttgcgctgcatcaccgtggcgcgcttgagcttcttgatcaccttcttcacggtctgcgcgtccgcgagcatgctcaggtaatcggctgccgccggaaagtcatgggcctcaggggcttccagccatttcacgctgagcatcgcgtgcctcccgtcacccgcgccgacaccgaggcagcctaccgcctgggcgccccgaaatttgggatcggtagcgatccgggcggtctgtactgacgccaggacgacgccatcggggcggcgcacgaaggaaggaaccacacgtgaaacgtctactcgcagctgcgacggggaccttgggctgcgctgcggccgcggtgacgctggtcggctgctcgagcggcggccactcggccgctccggcatcgagcaccgcgcccagcgcctccaccggcaccaacgcacaggtcaaggtgggcggcgccgacctgccgggcgtcaaccccgcctcggtcacctgcgtgcgcaccggcggcaagatcgacatcggcagcggctccaccggcggcgcccagcaggcgctggccgtggtgctgaccgacgaggccaccccgaaggtcgagtcgctggcgctggtcgtcgacggcaacgcgctggcggtcagcaacaacatgggcgccaaggtggggtcggccgacgtcgcggtcgacggcaagacctacaccatcaccggccaggcgcagggcgccgacatgaagaacccgatggccgggatgatcaccaaggacttcagcatcaaggtgtcctgcggctgatcggttgcggcccacgagcggcggacgtgcctcactcacgcgtccgccgctcgcggttcggccgaccagagcacggccccggtcttatgatgcagccgtgtcgatcccggacgggctgcagcgggcccgccgcatggcgttagcggccgacgaggccggcgcccgcgatctgctgctgtccctgataccgcgcatcgaacgggacgaccgagacgatctcatgctggaagtgcttgcccagcttggcgagatctacctggcgcgcggcgccgacgacggcgtcgaggaatcgatccggcgcatccaagactgcctggtcgcctatgcgagcatgcccgccgacgccgagaacgcgcgcatgatctgccgctactcgcggcgggccaggttcctgcaaacgggcttggccgccgcacgcggcgaccacgaaggcgccgcggcggccctggacctgttgagcgacaccggcggcgaattccccgagctcgccgccgaacacgcgcagctgtgcgctcgcgcgcgggcgctgtgcgccaccgcgctgtgcgacgacgacctgcacgtgcaatcggttccgttgtgggacaagatacttgagcacatcggcgacagcggcggcgacgagaacgccgatcacctgtgggtcaccgcagccaccggatacggcaggttctgcgtcgaaacggggcggttggccgaagccgagccgtggttacgccgcgccgaggcgcgggccgacgcccacggctgggaattagccagggccagagcacaattggagcgggccgcggcgcgctgggcggccaacgaccatgccggcaccgaacagctggtgtcgcaggcctatcccatcatcgcccggcatgcccgcgcgcacgacgtcgcacgctgctggctgtacctgggactcacccggctggggtcgggcgccctggaagccgccgacgaatgctgggaacacgccgagcggcactggcgcgagttgggaaacccgctgcaccttcaccgtattctgttgcagcgcagctggatagcgatcttctggagtcgcttcgccgacgccgtcgagctgatcgcccaggcccgggaactgctggactcctcaccgcgcagcagctggctgcagtacgcgcaactggacagtcatctcggaacggtgtggcgcgccgacgctctggcggacctgggtttcgacagctccggcgaccccgaggagtcgctgcaggagaccgaggcgcgccaggccgagggcctcggcatcctgcgcggcgaggtcggcacaccggaataccggcgcggcatgagcaagctgcagcaggcggccgagttgaaagtgcccgccgcgctggcggtcgactcggtgcggtattcgatcgccgacgccgacgcgcgagcacgctgggccaccaccatcgcggcgcccatcctggccggcgcgttcgcggtggcctgggagtgggagaacaccgcgctcatcagtgagctggtggaataccacagcgcgcgagggactttcgaagccctgcagcgcccgcagaccggcgaatgggcgtccacggccgtcgcatcggttccgctggacaccggcgccgagcccgctgcgctggccgccgccgggccgccggtggccggcggtgtgtcgctgacccggctggggccgttgccgccgttgcggatgcacccgggcgaggcgccgatcctggaccactaccgcacgctggccgtgcaacgctacgggcgcgccgtcaccgccgacgagccggcctggtcgacgtggccgtgaccgaatccggccggctgacactggtactgcgctacgccgacctcggcatcgccacctacgccagcctgcggatcgtcgggcagcccgagcggaccgtcgcctgggtggtggaggaaccgctgctgctggccgccctgcaggagctcgccgccgcgttgcccgagccgcacgacgccgagaatcggcgtgccgccatcggccgcgcgctgagcacgggggccttcgccgcaccggacaccgaactcacgctcgcctacatcctgggcgtgctgctgatcggcagcgcgggctggcagctgttgaccgaatgtgtgtcgtcgccgcgagcggtgctgttcgtctcgcccagcgcgcggctggcccgggtgccctgggggctgctggcgatcccgaaatcggggcccagcaaggaggagctggtgcgcgcccgccaggacgcgatcaccgccgccgggcgcgccgcggcccaaatcccttggcgtctgggcgatttggcggcgctgaccgatgggcatcggctgatggaactggtcgaggtgctgatggcggtaccccccaacattgtgcacgcgccgcggacggccaccgaatgggacgcccggcgcgacgggccgccgttgctggtgctcgacccgcgggtgcccgggcagcggccggactccgcgctcgggtcggtgctgggcaggccgtcgccgggcacgccggtcggccggcacttcgccgagctgatgcggcggcgacccgtgctgccgcgggtcgacgcggtggtcgacttgttccgccggcgcgacgccgaccgccgctggctggccgggctgctggcccgatccccgtgccggctgctctatgtcgggcacgccagttcggcggacgacgatcaccggcacggcggccgcgccgatcgggcggccctgcatctggccgacccggcggcggtgcccggcgacgccaacgccatcggcgatcaccggccgctgaccgcctcggatttgatggcgctgcggttgccgatgccgccgcgggtggcgctgctggcctgcgggtcgggcggcgactatcagttcgacgaggcgaccggtctggtggcggcgatgatcctgaacggggcgcagctggtgaccgcgacgctgtggtcgctgccgacgaccgccgcctaccggcaattcgcgatgccggcccgcgaatcccccgaatccgtcgacccgatggccgatctggtgtccgccgtcgacaccgcgcacgacgctcccgccgacgccgggtgcgcgctgaaccggtggcagcgcgcccagatgcgacgctggcgcgacggggatcgtgttgccagcccgctgtattgggccgcactggccaccttcaccgtcgatggtgcgcgctagtgctacagcgccgccacccatgccgcatgcacggccagcacgtcgtcggggagcgaaagctcctcgcgggcagcgggatcgaaggcgaccagcacaacgagcccgggccgcagcacggacaggtccaggtcggcatcgcagcgcgccagcttgccgatgaacgtctcccccgacacggccaccacctcgatgaagacctgacgcttgaccttgcgcacggtgccgactccgacggtgcggttgccgacgtcccggcggcggcgggatttgagccagtcggccagccgcagcagtgtgttcatccgctcagggtgacgcggccgatcggctaccgaacccaacttcgcggctgccgcaaccgttgcgccggccctattctgtgctgatgagcgccgaaccgcagccgccgaccgtgccggcgggcgcggcggcggggcacccccgccggtcggtgatcgaggcggcgtggcgggcgatcgggcccggcgtggaggtgctcagcgccgacgacggcggcccgttgagccgcaccatcaaacgcatcatcgacccgttggtgttgcggctgcggtccaacccggcgtattcggccccggtcgtcacgcccgagacggccgcggccatgcacgagctgatcgtcggcagcgggcccgaattacgcgctgccgcagcatggttcgaggcgctcaagctggaacgacgccgacagcggatccgcaccggcaacgcgcaggaattctacttcccggtctgcttcgaactggcggtgaccaagggcgcgccggcgccgcacgataacgagacggcggccgccgtgctcgccggcatccaccgggatcgcgatcgcaccgcgatcgaggttctgcaccgatacgccggcaaccccgatgtcgttgccgcgctggccgatcagctgcagcgcagctggcgcgacgtgcgagccgggcccgccgacaccggcccgtttctggccgagctcgccaccgtgctggggatggccggaggccatcgcggcgcggcggcccgccaacgcgtctggtcggcgatgatcaccgacgccactccctacaatctcggggcgctggcccacatcgattgcgcctcgctgccctggtccatcgtcgaggttgggttgagttccgttgagccgcaacgtgtcccagaggtcgcggcggcctccgagggggagcgcccgctggatcgcaacgtgctggaccgggtgcgcgccaccctgcggcgcgccctggaccgcgacgcgctgcccgacatcccgttgctgtgcgaggaggaggtcgaccgggcgtgcgcgccctggggattgctggccgaggacaagcaggccgcgctggtggccggcatcgaggtcgccatgcagctggccccgctggacccgtcggcctgctgccgcgacgacctggcggcgcagatccaggcgcggctgcgcaaggaagcctacgtcttgcacgcccgacgctatcttgctgacaacggcccgatccatccccgccagcagcaggtggtcgacgacctcgccgcgttcgcgcagccctacctgagtcggctgtgggcgcggctgcacgggcgcgacgtgtggcaggagccctgcgacgacgtcgacgacgtgcgggcgctgctcgacggggtggcccgctcggtgagcctcgaccaccggcagcggatcaaggcgatgctggaattgcaggtggccggatgagattggttgccgattccgggctttggaccaccggccgggcagacgtcaccgaggagccgccgctggtggccctgctggaggtcagcggcgcggtgctgtcgtggaccctgaacgatccggacgacgcgccgccccggctcaccttcaccgacgtgtcgcgggcggactggttgtggcgggtgctcggcgaagccgggcatgtggcgctgctgtcggcggtgcgggacgcggccgtcccagcgggcggcatcgagcttgccggcgtcgacgtcgcgccgggcgcgctggccccgctgcgcaggctggccaccggtcactggttgcgccgctggtggccggccagcaggcaggacggcatcgcgggcctggaccgtgccctactggacgccgagctcgcgctgctgaccgcgggtgcgcagcacttcttccccgacgacaccctggactccgacgtggccgggctgctggcgccgcacgccaccgcgctgctgggccatctcgtcagccccgatccgcgggtggcggacctggtgcgcgcgagcgccggcctggccgacggcatcggcgtggacgccgggcgttggccggaactgcttgccgcgcttgatgattcgagtctggtcgtggcgccgccgagcgatcggcgcgacgactacgcgctggccgccggcgccggagccgggccccgcgcggccgccatcgcccgcggcgtcgcatccgtcgcctggtcgggggtgccgcccggtgtcttcgatgcggccgaagacaccgtcggctggagcatccgggtcgacggttcggccgtcgtcgccgtcgtgcaggccgacgtcatcggaccggacccggccaccgggatcgcggtgaggctgcgctcggccgccgtcgagggtgcgggcgccctggatgccgccggccgcgcgaccttcccgctgaccggcgcccgcggggcactgaccgagtcggcggcctgggaccacgactggtcggcgaccgaggtgcaggtcggcgccgcggtgtcgaccgagtcgcggcatacccgcgagcgggtgcgccggtgggcgcggacgcggctggagtcgccgccccgggacgccttcctggccgagagattggccgccgaatctgcctattagacctacgtagaaccccgccgattccctatgctgagcgagtgccaaacacctatcgagtggttcagtggaacaccggcaacgtcggcaagagctcgctgaagtcgatcgtcaccaaccccacgctggaactggtgggctgctatgcctggtcggcggagaaggtcggccgcgacgccggtgagctggtcggcatcccgccgctgggggtcgcggccaccaacgacgtcgacgagctgctggccctcaagccggactgcgtggtctacaacccgatgtggatcgacgtcgacgaactggtccgcatcctgtccgccggcgtcaacgtggtgaccacggcgtcgttcatcaccggcggaaacctcggcgacggccgggaccggctcctgcaggcctgccagcagggcggcgccaccatcttcggctccggcgtcagcccgggtttcgccgagctgctggccatcgtgtcggcgatggtgtgcaaccggatcgacaaggtcaccgtcaacgaggccgccgacaccaccttctacgactcgccggagaccgagaagccggtcggcttcggccagcccatcgaccacccggacctgccggcgatggcggccaagggcacggccatcttcggcgaggccgtccggctggtgggcgacgcactgggcgtggagctcgacgacgtgcgctgcgtggccgagttcgcccagaccaccgaggacctggtgatggcgtcctggaccattcccgcggggcacgtcgcgggcacctacatcagctggcagggcatcgtcggcgaccaggtgctgatcgacttgaacgtgcggtggcgcaagggacagacgctggacccggactggaagatcgagcaggacggctgggtcatccagatcgacggacagcccaccgtgaccaccaaggtgggcttcctgccgccgccgtacttcgaggccaccacgatcgaggagttcatggacctcggtcacatcatgacggcgatgccggccatcaacgcgatcccggccgtggtcgccgcggcgcccggcatcgccagctacgccgaccttccgctgacactgccccgcggcaacgcgcacgtcgccggccagccatagcgccgccggtagccatcagtcggcgcgctccggcggctcggtatcgccggaccgatcgggcggcgactcgttgagatagcgccgcagccgcagcagctgattgacgacgatgccgatgcccagcagcatcagccccaccgccactgccaccacgatcgcggtgctcacggggtccatgatggcagggccgggtttgcgaatccgcgtttgccgggtagaaagcaggccatgagcttccaggtgcgggcggcgttgacggtcctgacggccgcggcggcactctgcgtcgcgccgatgccgggcgcgccggcggccggcgccgatccgtgcccggacgtggaagtggtgttcgcccgcggctccggggagccacccggcatcggcggcatcggtcagcccttcgtggacgcgttgcgctcgcagatcggctcgcgatcgctggccgtgtacgcggtgaaataccctgccagcactgacttttcgaatcccgatttcccggccaccgtgatcgacggaatccgcgacgccagttcgcatctcgagtcgatggtggccagttgccccaacacccgggaggtgctgggtggctactcgcagggcgccgcggtggccggctacaccacgtcggcggtcgtgcccccgggcgtgcccgcctccgcggtgcccccgccgatgccgccggaggtcgccaaacacgtcgccgcggtcacgctgttcggcacgccgtcgggccagttcttgcagaagtaccacgcgccgccgttggccatcggcccgctgtatcagcccaagacgctgcagctgtgcgccgtcggcgacccgatctgcggcaccggcggcggcgacgacctggccgcgcacacgtcgtatccggtgaacggcatgacgaaccaggccgcccaatacgtctttagccacctgtagcggccctgggagaatgcgggccatgcgggttctcatcacgggcggtaccggattcgtcggcgggtggaccgccaaggccatctccgatgccgggcattcgatccggttcctggtgcgaaacccgggcaagctgcacacctcggtcgccaaactgggcgtcgacgtgtcggacttcgccgtcgccgacatcaccgatcgcgtcgcggtgcgcgaggcgttgcagggctgcgacgccgtggtgcacagcgccgccctggtcgccaccgacccgcgccagacggccgagatgctcgccaccaacatgcagggcgcccagaacgtgctgggccagtccgtcgagctgggcctggatcccatcgtccacgtgtcgagcttcaccgcgctgttccatccggacctggagacgctgacggcggagttgccggtggtcggtggggccgacggctacggcacgtccaaggcgcaggtggagatctatgcccgagggctgcaggatgcgggcgcgccggtgaacatcacctacccgggcatggtgctcggcccgccggtcggcgaccagttcggcgaggcgggggagggcgtgcgggccgccctgcagatgcacgcgatcccgggccgcagcgcggcgtggctgatcgtcgacgtccgcgatctggcggcgctgcatgcggcgctgctggagcccggccgcgggccgcgccgctacaccgccggcgggcaccgggttccggcgagcgacctcgccgccctgctcggcgaggtggccggcacgccgatggtcgccgtcccgatcccggacaccgcgctgcgcgtcgcgggcgcggtgctggatcgggccggccgtttcctgccgttcgagaccccgttcacctgggcgggcatgcagtactacacccagatgccggcatcggacgactcgccgagcgaacgggaactcggcatcacctatcgggatccccggcagaccctggcggacaccttcgcggccctttccgccacctcatgacccgacggccccacccgggcgactccaccacccgtgacctgctcatcgacgcgaccatcaaggtgatggtcgaggacgggtacgccgcggcgacctcgcgccgggtggccggcgaggccggggtgaaaccggcgctggtgcactactacttccccaccatggacgagctgtatctggacgtcttccggcgcggcgcggccgcctaccaggaacgccagacccgggcgttgacctccgagcgcccgctgcacgccctctgggacaccctgatcgagccgaaggacacccggctgctgctggagttcatgggactcgccaaccaccgcaaggcgattcgcgccgagttggcggcctggttcgggcgctggcgcgatacccagatcaccgcgctgaactccattgtccgcgaacacgacatggacgccggcgaatttccgccggccggcatcgcggtcatcctggccgcgatcgggcgcatgctgatcctcgaagatgccctcggcgccaccgccggacacgacgaggccgtcgcactggtcaaccggttcatcgaccggttcgagttgccctgacggttcagggcaccacgatccgcagccgctcccagccccgcacggtcgacgtcgacgccaattgcgctgtgtcgtaatcgatgtcccattcgggccatcggttcagcagctcgtccagcgccacccgctcctccagccgggccaggttggcccccaggcagtagtgcacgcccttgccgaaagtgatgtgcgagatgttgtcccggtggatgttgaaggtgtccgggtcggtgtagcggcgcgggtcacggttggcggcgccgaacagcagcagcatggcgctgccggccggcacggtggtgccgtagcactcgaaatcggccgccatccagcgggcgacgtgcggcccggtgggttcgaagcgcagcgtctcgtcgacggtgcgggtcagcagggaccgatcccggtacacctcgcggcgctggtcggggtgttcggcgagaacctttgccagccagccgatcagccggccggtggtctcgttgcccgcgccggcgaccacctgggtgtagtgcagcacctccttgcgggtcagcttgcgccgcaccccgtcctcgtcgtcgaactcgacgttgagcagtgtcgtcatcaggtcgtcggagggattcttggatcgccattcgacatagtcggcatagatccggccgtcggcgatggagtcggcgtcggcgacccgcagcggcgcgcccggcttggtgcgcaggttggcgtcgttggcgtcgcgcaccgaaaccggttcggactcagggattcccaacaacatcccgatcacccgcatcggcatcatcgacgccagctcggcgatgatgtcgaagctcgaggagccgaccagcggatccaggcaccggatgcagtattgccggatctggtcttccagcgcggccatccggcgcggggtgaacacccgcgacatcaggccgcgcagcacggtgtgctcgggcgggtcctggaacatcatgacgccgccgggcatgtcgaacttcgactggatcagctccaggatgtcgctgcggcggttggagaacacctgccagttcgccagcgcccgttccacatcggaatgccgtgacagcgcccagaagtcgtaccgctcgttgtagtagatcggcgcctcttcgcgcagccgcgcgtacgtcgggtaggggtctgtgatgatgccgatgtcataggggtcgtagtacacggccgtgtcgttcgtgacggtcatcgatgcatgtccttattgaccttgccgtccagccggcccatgccaacctccaccgatcggatgttgggcgatcgcccaaatttgtgccgcaggccatgtctagcagcatcgcgtcgagtccgtcaagacgccgcgggcgggcaccgatctgtgaagatttgcggcatcggtgtgaaggcttcgttaagaacgaggcaccggccggctccgaccggcaccgtaacaggcatgacggtcgtcgagttcaccggcggcgccgcgccgcggggtgcgctgccgagccggtccacgctgcccggcccgggttcggtgcgggtcaccgccgcgtacgcggccgcgctgctggtggtctatctggtcctggcggcgctggggccgcacgcccgccaggtcgccgtcagccggatgagcaccaacgtgcacaacctcgggcggggccagctgggcaccttgatcggcagcgcgttcgtcgacgacggcggtgagctgttcttctggctgcccggcctggtctgcttgttggcgctgggcgagctgctgtggcgcggcaaggggctgctggtcaccttcgccgtcggccacatcggcgccacgatgatcgtggcggtcgggctggtcgctgccatcgagtccggcatgctcccggcctcggtggcccgcgccagcgacgttgggatcagctacggcgcgatgtgcgtgctcggcgccatcaccgcggcgatgccggtgcgctggcgcggcgtgtgggccggttggtggttgggcacggcggtggtggcgacggtgggtgcggacttcaccgccgtcggccacgtggtggcgctgctgctcggcatcggcctgtcgttccggctgcggtccacggccagctggacgcccgtccacctggcgttgctgtgcgtcggtgccacgttcggctatctgctgctggccggggcggcgtcgatggcgccgatcggcgggctggcgggcgcgttcatcggtgtgctggcgcgccgcccgctaggagcctgctgaattaggggattttttggggcggggcgtctcgaaccgtctagcggcgtgttgtagtcagaccctgtgggtcgacagaaaagagatcgccccgccgttgttgagcgtggcagcggtcggcggctgaggcaaggccttggtgtgagggcgtgttaggcgatggcccaggtggtgtcggtgcgggtcaggcccatggtgagcagccgacgtaggttcagtgctgcggcgcggtggtgcagccaatggttgtttttggcggttcctcggtagcggaccttgcggttgccgcgagtgagccaggccattgagcgttccaccatgggccggtgttggcggtattcggcttgccaatcggggtcgcgggccgcgacgcgagcagcgcgcaataattgctcgtggatatgaagggtgagtttgcgtccgcgcgtggcggtcgtgcaccgggacgccaacgggcatgagcgacagtatctttcgaaggtgactccgccactgggacggatcggcattccgtgtccagccgggcaggtcacgatgcgggcgtcgaaatcgatgaggaaatcgtcgctggtgaagccacccggaaccggcgagcgtagcggtagcggtttgatcaccgcgacatggccggcgtcggccagtgccgcccgggcggccccggtgccatacgccgaatcgcccaggacccgcaccgggggtgtgttcaccctcgagcaggctcagcccgacgacggcctcgtggttgtccgcgccgctggccttggtcaacgcgcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcgccagtgcccgtcggtgccatcagagccctcgaccggttcaacgtcttgaccggcgatcaacgccaacaacgccaccgcctcagcagcccgcggcgcgagttcctggtcaggcagatagcccagcacccggtgagcatcaccgaccaaaccatccaccagccgatcccgagcggccttatcctcccacgcaatcgcgggtttccccggatcgtcgtaatcatgggcgctgcagtgggcttcgatcaccgctgcagcgccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgtcttgaccgcctcaaagatccggttgggccgatccgaagccgccaaccgacgccgccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggccatcacctcagccggcacgctgggccggccccgctgcgacgggaacaagtccgcgaacatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatccccaaaaccccaggacaactcgtcccgccacgcggaattaattcagcaggctcctagccggacagcccgacgagcgcgtcgacgtggtagcggctggccgtccagggcggtgagccggcggtgggcgtcagcgtgaccgtcagttccgccttgcccgcggtgaccgatcccgggaccggataggtgtcgtccagccagcggtgaaaagggttggcgcgcggctgaaaccagttgccgacgggagcgccgtcgatcgcgacgtcggccgattggaacccgttgacctggtcgccgctgcggcgcagcaggacgccgtggttgtccggatcgacctgcacatggaaggtgatcgccccctgggcgctgcgcacggtgccggcgaccgggcgggtgtcttcggtgccctcgtactcgctgaccagcagctggtcgatcgcgtcggtgtcggtgtagccgtgcagggcccggctgagcggatcggtcgggttgacgtcgtcggtgccggtcagctcggcgtccggctgggtgtagaggaatgcggttgagctgtaatccggttcgaccatgttgcgtttgccgtgctcgatgccgaatcggagcgccgagtgatagccgatcgcctcggccggcatgatccggtacacggcgacgcagtagtcggcgcacccggcggtggccgtgcgttggtcgggttggccgttgagcggatcgctgaaatgcgtaccgtccttgaagtaccagccgccctcgtagaggtcctcggttccggtgccgtaccactgcggggaggcggcgccgtcggtgtagacccgctcggccccttccaggaagtagggggcgttgtcgctgaacgccgttcgggtccgttggccacggatggtctggctgacgccgacgaacttgccgcggccctgttcgtcggcgaacggccagtcctgcccgaggatcgtcgggccggcgtgggagcgcgcggtgaagtagccggcccggccgctcgccagcgcgcccgcccaccgggcgtcgggagtcgtcgtcacctctgcggctatcccgaagaccgggccggcgccggtgttggccaggctcacccgcgccgagcgcgcgaaaggcattggccaccaacaccacagcgccatcgatccatcgggttgcgggaaggcggcgaacatcagcgatcgcaccggggtggggccgagccccgcgccgaagaactcgcccagcggggagtcgaccgtggtgcggccgtcgaactcgatccgcagccgcaacccggtcagcgattgatcggccggggcaggcaggtacagccgcagtgccgagatgctcgccgggccagtcgattcggcgatcgtctgctcggcaccgccgggcaactcgatcacccggttgctgtgcacctcgccgggtgcggccggtttggggtctacggtgccggcggcgcgaaacctgtccagcacatcgaccgcggggtcggcgggtgagaacgtgctcactccctcggcggtcggaaactgtcgataatcgacatggtagtactccaaatgggattcgacactgattcgcatcgaccgccggtaaggcatcggcaccttgatgtagtcgcctcccggcgactcaccggcgttggccaccaacggccacacgaacggggcgcccagctgtccgtcgaccaacgattgcaccggcgtgtccagcacggtctgcccgtccagctcgacgcggatgttcccgatcgcccggagattgccgccgtcacgggtcagccagatcgaatcaacctctcccgcaccgtgatcctcggcgatgacgcagcctgcgccgccgggcgccaggcagccgccggtgccgttcttgttgccggtggagatgtcgaaatcaccgccgctgcggtcaaagctcgacagctgcaggctctgcgtatccgcactcaaatacggcaacaggtccagccggcggtaggtgtcccagcccaccagccggtcgccgaatggccgtgccgtccaaggcgacggctgcgcggcggcggagccggtcccggcgatcaccagcatcagtaacgcgaacatcgcgggaaacaaccgagcggccaacggccaagccgtatttcggttcccccgaacacactgtgcatcgccctgcattgtcaaaaatgtaggtccattcgcgtgctctccatgctatcgcccattgtgtcgttccggaaggcattgcgagatcaatcaggtgacgtaatgcgttgctatttccccgaatccctaggtattccgtattcaactcacgtatgataagccttctcgggcgaagcattccttctcgacgaacggagtggtgatgtctcgtttgaagtacaaactcgttctcggcattgttcttgccgccaccgccatcacaacctcggcctgcaccacgccggtcaccatcgattgcacgcccttcacctgcatcggttgagcgtcgcggcgcggggtcaattcttcttcttgtgctccgtatcccggctgggctgaacgcgtttgggttcgccgggcattttcgggtagttcggcgggtagggcatgtcgccgagcccgcgctcctcgtcggcctcggccatccgcagcagcggaccgatcgactgggccacgtcatcgattgcagcccaagggttttcgcgggcgctgaccagatcgggcaccgtggccatggtgtagtcatcggggtcggcgccggccagctggtcccaggtcagtggcatcgacaccgtcgcgatcggggtgcgccgcaccgaataggccgatgccatggtgcggtcgcgggcgttctggttgaagtcgatgaagatgcgcgcgccgcgttcttccttccaccaggaggtggtgacggcgtcgggcgcgcgccgctccacctcccgggccagcgcgatgcccgcccggcgcacctcgacgaaatcccagtccgtggcgatgcgcaggaagacgtggatgccccggccgccggacgtcttcgggtagcccaccagccccagctcgtcgagcagcggccgcagcacgtcgaccgcgacgctgcgcgcctgggcaaaggcgacaccgggctgcgggtccagatcgatgcggagctcgtcgggatggtcggtgtccgggcagcgcacctgccacgggtgcagggtgacggtgcccatctgtgccgcccacacgatggccgccgggtgggtgaccttgagcgcgtcggcggtccgtcccgacggaaacgtcacccggcaggtctgcaggtagtcgggatggtgctgcggaatccgcttctggtagatctcttcgccgtcgatgccgtccgggaaacgctgcaggtgggtcggccggtcgcgcagcgcgtcgagcatcgggccgcccgcgacggcgcggtagtagtcgatcaggtgccgcttggtgcctttcgaccccagcttggggaaatacaccttgtccggatttgtcagacggaccgcgatgccgtcgacgtcgacctcttctgcagcagccatacctccgattccagcacaatcgggctatggaccttcctgtcatgccgccggtgtcgccgatgctggcgaagtcggtcggcgcgattcccccggccgcgtcgtatgagcccaagtgggacggcttccggtcgatctgtttccgcgacggcgacgaggtcgagttgggcagccgcaacgagcggccgatgacgcgctacttccccgaattggtggcggcggtgcgggcggagctgccgcagcgctgcgtgatcgacggggagatcgtcatcgccaccgaccacggcctggacttcgaggcgctgcaacaacgcgtccatccggccgagtcgcgggtgcggatgctggccgaggccacgccggcgtcgttcatcgccttcgacctgctggcgctgggcgacgaggactacaccggccggccgttccgcgagcggcgcgcggcgctgctggaggcggtgggcggtccggggccctcgatccatgtcacgccggcgaccaccgatctggacaccgcgcggcggtggttcgacgaattcgagggcgccgggctcgacggtgtggtcgccaagccgttggacatcacgtatcagccggacaagcgggtgatgttcaagatcaaacacgagcggacggccgactgtgtggtggccggttatcgggtgcacaagtccggggcggacgcgatcggctcgttgttgctggggctgtatcaggatgacggccagctcgcgtcggtcggcgtgatcggcgccttcccgatggccgagcggcggcggctgttcaccgaattacagccgctggtcaccgatttcgaggaccacccgtggaactgggccgcgcaccaggccggcgagcgcacgccccgcaagaacgagttctcgcgctggaacgccggcaaggacctctcgttcgtcccgctgcggcccgagcgggtggtcgaggtccgctatgaccacatggagggccggcgattccgtcataccgcgcagttcaatcgatggcggccggaccgcgacccacgctcctgcacctacgaacagctcgagcagccggtgacgtttcgcctggacgacatcgtgccgggcctcggcgcgagccgcgcagatcacaagcccggcaagcagattggggctccatagcacggcggcccgccgagcggctgccggggagcgtccccctcccagacgaattggccgacgttgcccatgccgccgacgggaacccagtaccagtggtggcagacgttcatgtcccagcggacatcgggcatcggcaacggctgtcccaggcaccagtcgtgcgggaccgtgaaattgtcggtcggcaacgggccgatgagatgcggcgcgctgggttgcgcggcggccgaggcgatccccaggcctgccgccgcgatgccgccggcgagcagcgccccggcaacgaccggcttccggtggtgggtggtgttcatgacgccagcacaacgctacgccgcggctaccgatcccaactcgaaatgggtgtttagcccctcgccgcagcgggcacgcgaaccgcatgtctgtgacagccttccaggacttgccgttggccgatcgcgaccgcgagtgggacggcgatgccgccgagaagcgcgtccgcaaatgggcgggcgcgcaagacgagccgaacgagaagtaccgcgacgcccacgtctggtacgacgccgacaagaaggacaatttcacggcgtacaagctgttgatcgccgacgtgatcggcggcgagctcaaggccgtgccccgcggggtgatggcggccggcgcgatcatggacggcgcgcgcggcggcatcgacgtgcccaagtccgacatcgatcggatcaagagccacctggccaagtactaccagaagatgggcgagagcccgccctgggaacgaagctagcaccccgaggcatcgccggcagagggcgattccgttcgccgaacgtgggggacatggatgaaaccgcggcccgaatcgtgcataccccccacgctcgacgcgagaccgcgagaccgcgagaccgcgaggcagcgaggcagcgagaccgcgagaccgcgagacagcgagacagcgagaccgcgagaccgcgacgaaactagaccgcgaccaccagccgtgacagcccgcgcagcgtcacgttggtcttgtactgcggttcgccgtccaaccgtgcccgcgggaagcgggccgtcaccgccgacagcgccacaccggcttccagccgcgccagcggcgcgcccaggcagtagtgcactccgcgaccgaaccccaagtgccgcaagcacttacgatcgggatcaaaggtgtcgggtcgatcgaactcggcggggtcacggttggccgcggcgagcagcagcatcatgacatcgcccgccggcacctccacaccgccaatcaccatgtcgtccaaagcgattcgcccggccagctgcacgggcgggtcgtagcgcagcgtctcctccacgatcgccggggcccggcccgggtcggcgcccagcgcggcccactgaccggggtcgcgcaacatcgccaggacggcgttgccgatcaggttcaccgtcgtctcgtgcccggcgatcagcagcaggttgcaggtggagacgatctcctcctcggtcagctgatccccggactcctcgacggcgatcagccccgacagcaggtcgtcgcccgggcgtgaccggcgcgcctcgatgagctggtggaagtagtcgcgcagccaggtcccggcccgttgccgctcgctggcgacctcggccggcaccccggtgatcgtcgagaacggatccagcgcctgggccagcagcgccgacgcccggctgaactgcggctcgtcgtcgagcggcacgccgagcagccggcagatcaccgccaccggcagcggataggcgaagtcctcgacgatttccaactcgcccttgtcggcggcacgatcgagcaatccgtcgaccagcgaacggatatcgggttccagcgcggcgaccacccggggcgcgaacgccttgctgaccagcctgcgcagccgggtgtgatcgggcggatcgagaaacaagaaacccggcgggccctgcctgaccggcgccgtgcccgccgcggcctgccgcttggcgacggtcgagttgacgttgtcgctgctcgacgacgggtgccgcagcacctcgtcgcagtcccggtaactcaggaagacggccaggttggcctcgggcagctgcaacgctccgcgctcacggaattgggcgtaaagccggtacgggtccgcccggttggcggggtccaacagctgcagcagcagcccttgcgattcggcggactcggtcggcgcggtcgtcatcctgacattgtgcccgccgctgcgggcgcggccggatcagcggcgcaggaactccacgatgtggccggccagctcggcgccggcgtcctcctgcaggaaatgtccggcgccgcggatcaagggatgatcgatgccctgcgcgccgcgcatctcacgctggaagatggccgccatcggcccggtgatggggtcactatcgctgaacgcgaccagcatgggcgtcgggctcacggcgagcttggcccacgccgccttgttggccgccgcggcgggatcctccggggaggtgggcaccagggtgggcatggcgcgcgggccggcgcagtactcgtcggagggaaacggggcgtcgtatccggcgcgttcggcgtcgctgagccgccggcggcaaccgccctgcacgaacgcgccgatgttcagctgcggcgccgaggtgatggcctcccggaaccgccaccagacgtcggccatcggttggtcgccgttcggcagcccggtgttggcgacgaccagccgggcgaaccgctcgggatgctctgcggcgagccgcaatccgatcagcccgccccagtcctgacccaccagggtcacgttgtgcaggtccagcacgtcgaaggccagcgcgcgcatccattcgacgtgccgcgcatagctgtggtcctcgcggcgggtcggcttgtccgaacggccgaacccgaccaggtcggggcagacgacgcgatgaccggcgccggccagcaccggaatcatcttgcggtacaggtaggaccacgacggctcgccgtgcagcatcaggaccgggtcggcgcccgccgggccgtcttcgacccaggccacccgcagcgcgccgccgtcgtcgtcggaaacctcgcaataccttggcggataagggaaatcggggacggtgtggaacctgtcgtcgggcgttcgcagcgtgtgcatgtcaggtcccttcggataatccggccacggccggctgcgccatcaaccggtcgagaaatccgtgctggctcttcaagagtttggtgcgtgcggcggccaccgggaaccagccgacccggtcgacctcggggaactcgcgcagcgtgcccgagcccttgggccattccagcgcgaacgtgttgctgcgtgcctcggtgacgtcgaggtcgccgtgcacggcgaagacggtcaccagcttgccgccggactgcttcagcgtgccgagatcgatccgctctcccgccggcacggccagtcccagctcctcggcgaactcgcgccgcgcggccggccacggatcctccccctcgtcgtactcccccttcgggatggaccacgcgccgtcgtccttgcgcgcccagaacggcccgcccggatgcgcgatcagcacctcgacgacgccgtcaccggttcggtacagcagcacaccggcgctgagtttgggcatcgaatcctattctccgacagcgcgttccaggtccttgagcgaggactccaggtgcatgagcaggcgctgcaggtgcgggacgctgcggcggcaaccgaccaggccgaagtccaggttgcccgcgttgctggccagcgtgatgttgagcgcctggccgtccagcacgatggacagcgggtagttcccgtccagccgggcgcccccgtaatacagcggcgcggtgggcccgggcacattcgagatgacgatgttgaacggcggcgaggtcgccgacacccagcccggcaccgcggccagcgccagcgacgacaggttggccgcggacagcgccagcgcctggaagcggggcagctgcgagaacaccttcttgttgctgcgcatcgactcgctgatggtgagcagacgctgcgccgggtcgtcgctgtcggtcgcgaggttgcacagaatcgcccccaccaggttgccgcccgcgtcggcttcctcctcggtgcgcaggctgacggggaccatcgcgatcagcggcgtgtcgggcagcgcgttctgctcgagcaggtagtaacgcagcgcgcccgaacacatcgccagcaccacgtcgttgacggtgacgcccgcggcgttcttgacgtttttgatccgctccagcggccacgactgcgcggcgcagcgccgggcgcccccgatcttgacgttcagcatggtgcgcggcgccccgaacggtaacgtcagctgctgctcgaccagcgccgcgcgggccagcgacaccgtcgaaggggcaagggcggcaacggatcccgcggcatgcaccagggaactcaaccgggagctggggccggccttgcggctgcgcttgggcagcgtccagggcgcgcggatctcgaggtcgtcggggtcgctcgacagggctcgctgcatcagcttctgcgcggacacgccgtcgatcagggcgtggtgcaccttggtgtagatggcgaaccggccgtccttgaggccttcgacgatgtgcgtctcccacagcgggcgatgccggtccagcaggctgctgtgccaccgcgaggtcaactcgagcaattcgcgcacccggcgcggcgacggcagcgccgagcgccggacatggtagtcgacgtcgacgtccgcgtcgtaggaccagcccaggttggcgatcccgccgacgaacttcgccgggtgtttgcggaacgtgggctggaaatccggttgtgccaccagttgtttgtagaagtcccggacgaagtttcgaccggcgccctccggcggctggtacaactgcaacccgccgacgtgcatcggatgttcgcgagactctcccagcaggaagaccgcgtcggtgggcatgatcagttccatccacccattagacgccatgcgggcggggaagtcgctgtttacaacaggtcggtgatggtcttcaggccggcgtcgtagagcacgccgggcagcatgccgccgtcgcactcgatggtggtgccgttgacgaagtcggcctgcccgccggccaggaacacacagatgcggcccacctcggcgggttcgccggcgcggcgcaacggcacggcggcgaaatacttctccccggtgggatcgtccttgggcagcacgaacgaccggaagttctcggtcatcgtcggccccaacgccacgcagttgaccctcaccttcggcccccactcctgcgccagcgatcgggtcaggtgattcaggccgcttttggccgcgccgtaggacaccagcgtcggcgatccggccgggtgtcccgcgccgctggagatgttgatgatgcagcccatccggtcctgggtttgcatctgccggtaggtgcggatcgcgaaccacagcgggccgatcaggttcatctgcaccgcgaacgcgtggaacagggcggtgcgcgcatagtcgtcgtcagcggcgggcgaaccctgaatgcgttgcaccagttcgggaatgctttcggcgtgcggcgcgggaacggtgccgccggcgttgttcaccaggatgtcgaggcggccgtgggtcgccacgacgtcggtgacgaacgcgtcgatgccgcggtagtcgccctgatcgcagacccgttgaaaggcccgctcggtccagtccggttcgatgccggggatggtgtccagcggcgagcgcgcgcagccgacgacggtggcgccggcccgcagcagttcgtgggcgatgcccacccccacgccccggctggtcccggtgacgatcgcgaccttgccctcgaggacgcccatcgcagcacccttcccgtaaccggcgatgattgacagtcactgtcagcgagtcatagcctgccatcttgtttatcagtgtgtaaaggtcgatgtgaaaaactccgggaggtcaacgatgagtagcccgtccaagcttcgcgtcatccagtgggccaccggcggtgtgggtaaggcggcgatccagtgcgtcctgaatcatccgcggctggaactggcgggatgctgggtgcacagcgcggagaagaacggtgtcgacgtcgggcggatcatcggcacccaggacctcggtgtcaccgctagcaccagcgtcgacgaggtgctggcgctggacgccgattgcgtcgtgtacagcccgctgatacccaacgacgacgaggtcatcgcgatcctgcggtccggcaagaatgtcgtcacaccggtcggctgggtctatcccgatccgggcaacccgcggcaccgggccgtcgccgacgccgcgctggaaagcggtgtgacactgcatggttcggggatccaccccggcggtatcacggagcgattcccgctcatggtgtcatcgctgtcatcggcggtcacgcacgttcgtgccgaggagttctccgacatccgcacctacaacgcacccgacgtggtgcgccacatcatgggcttcggcggcacccccgaggaggccaccggggggccgatggcagggctgctcgacggcggattcaaacagtcggtgcgaatgatcgccgaccacatggggtttcgcatcgaccccaacatcaggaccatccaggacgtcgccgtggcgaccgccgacatcgactacgaccccttcccgatcaccgccggcacggtggcggcgcgccggttccgctggcaggcgctggtggacggcgagccggtgatcaccgcggcggtcaactggttgatgggtgagcaaaacctggaccccgcctgggatttcggtgggcgcggcgagcgcttcgaggtggagatcaccggcgaccccgacgtgagcctgacgttcaagggcctgcagccggagacgatcgcggagggcctggtgaagaaccccggcgtggtggtcaccgccaaccactgcgttaacgccattcccgacgtctgcgccgccgcgccgggcatcaagacctatctggatctgccgctgttcgcgggtcggccggcccccggcctcgccacgtcgtgagccccctcctcgacgacgcccatcggcgcatcgtctcggccggctaccaacccgaccaggagcccttcgagatcggcggtgtgcgcatgtttttcgtcaaggatccggacggaacaccggtcgagttcatccaactaccgggcggggcgcgcagcacctacgagatgcatcgcggcgtgcgactgcggctggggccggtcacatgagctacagccacccggattcgatgcgcgggcaggtcgcgatcgtcaccggcgccgcgcagggcgtcggcaagggcatcgccgccgcgctgctggaacgcggcgcggcggtgctgttggtcgacattcaacaagaaaccctggaggcgacggccaccgaactccgcgcactggggcgggtggaacggctcgtcaccgatctgcgcgaccccgacagcgccccgcgcatcgcggcggccgccgtcgacgcgttcggctcggtgcacgggctggtcaacaacgccatcgccaccaacgagcccaaggcattcgtcgacatcaccaccgacgacctcgcgctgggctatgaggtcggcccccgcgccaccttcctgctcatgcaggcggtgcacccgctgctggtgaaggagggcggcggggcgatcgtcaacctcggctcggggacgggcaccggcggcgagcccagatggggcgggtatgccgccgccaaggaaggcatccggggcctgtccaaggtggcggcgctggagtggggacgcgacaacatccgcgtcaacgtcgtctgcccgttcgccgagtccgacggcgtgaagctgtggaagcagttcgcgcccaacgactatgcgaaggcggtcggacgggtgccgatgaagcggatcggcgacgtgcgcaccgacgtgggtgcgctggtggccttcctgctcagcaccgacgccaccttcatcaccgggcagaccatccacgtcgacggcgggatcggctgcttccgatgacaccggaatcgctgcgtgaccggcagcgcgcacagatccgggccgacatccggcgcgcggcgttccggttgttcgtcgagcgcgggtacgatgcggtgacaaccgaggaaatcgccacggccgcaggtgtttccccgcgcaccttcttccggcacgtgccggcgaaggaggaacttctgctcgcgccggtgcgctacggcggcgccgcgatcgtccatctcctcgagggccgcccggccggcgaatcacccgacgtcgcgctgatcaacgccatcatcacccgcacccgctcgttcgagccggccgacaccgaggagtggcgtcaggccctgctggtggcccccggcctgctggacaaggtgaccgtgcaccggcctgccgacaaggaacgcgccaccaagctcatcgccgaccggatgcgagtcgacccccacaccgacatccgccccggcctgctggtccaactggccttcgccgccgccgatttcggctttcagcagtgggtgctccagtccgggcggcggtggccgctggaccgctacgtcgccgaagcgctcaaggccgtcaaaagtccgcactggaggcggaaatgaacgcgctcaatctcgttgcagcacttcgtgattggcgatccggatcggggtgccgtccagccaggccagcacggattccacggtgtcggcgtagaacgcgccgagcatctcacgggtgacgtatcccaggtggggtgacagggtcacgttcggcagggaccgcaacgggtgatcaccgggcagcggctcgacgtcgtacacgtccagcccggcaccggcgatgcgcccggcggtcagcgcggcgatcagggcgggctcgtcgacgatcgggccccgggcggtgttgatcagatacgccgacggtttcatcagcgccagctcgggttcgccgaccaggccccgggtgcgctcggagagcaccaggtggacggagacgacgtcggcggactcgaacagggcggccttcgacacccgccgggcccccaccgcggcggcggtgtcgtcggtcagattctggctccacgcaatgacttccatgccgaacgcggcggcgaatccggccatccggctgcccactcggcccagacccagcagcccgagcgtcttgccggacaacgtcattcccgccgtgcgctgccagcccccggcccgcatctgccggtgctcgtcggccaggtgacgcaccgtcgcgatcatcagcccccaggccagttccggcgtcgcgtcgcgcagggcggcgaaccgcgggtgggcgaactcggaccgggccaccgcgatcccgtgctcggtggccgcggccatgtccaggttgggcagctgccggccgacgatggtgagcagccgcaggtggggcacatggccggctggtagtcggcgtcgaccaggttgcactcgatctccatgccggtcagcggctgctcggactcgaagcacgaccgggcgagcatcgtctcgaagacgtccagacacagcgccaccttgcgccggaattcccgccgatgtgcgctgtcgtacgtggcgcgcttgacctcttcgcccacaccgcagatgcaacagggttaccgccggtaacgcaagcttggtcggcggtgagcgggtagaccatgatggacttctgccgccgacgtgtcaccgaacaggagagctgtggccgaattcgccgaattcatcgccgccatcgaccagggcaccaccagcacgcgctgcatgatcttcgatcaccagggtgccgaggtggcccgccatcagctcgagcacgagcagatcctgccccgggcgggctgggtcgagcacgacccgatcgagatctgggagcgcacctcctcggtgttgacgtcggtgctcaaccgggccaacctgtccgcggaaaaccttgccgcgctgggcatcacgaatcagcgcgagaccaccctggtatggaaccgcaagaccggccggccctattacaacgcgatcgtctggcaggacacccggaccgaccggatcgcgtcggcgctcgaccgcgacggccgcggccaggtgatccgccgcaaggcgggcctgcccccggcgacctacttctccggggcgaagttgcaatggatcctggacaacgtcgacggggtgcgcgaggcggccgagcgcggcgacgcgttgttcggcactgccgacagctgggtgttgtggcagctcaccggggggccgcggggcggggtgcacgccaccgacgtgaccaacgccagccggaccatgctgatggacttggagacgctggactgggacgacgagctgctgtcgttcttcaccatcccgcgcgccatgctgcccgagatcgggccgtcgtcgtcgccgcggccgttcggggtgacctcggacaccgggccggccggcggccggataccgatcaccgccgtgctgggggatcagcacgcggcgatggtgggccaggtctgcctggccgagggcgaagccaaaaatacctacggcaccgggaatttcctgctgctcaacaccggtgagagcatcgtgcggtccgagcacggattgctcaccaccgtgtgttaccagttcggcgacgccaaacccgtttacgcacttgagggttcgatcgcggtcaccggcgccgccgtgcagtggctgcgcgaccagttgggcatcatcagcggcgccgcgcagagcgaatcgcttgcgcggcaggtcgacgacaacggcggcgtctatttcgtccccgccttttccgggctgttcgcgccctactggcgttcggatgcgcgcggcgcgatcgtcgggctgtcgcggttcaacaccaatgcccacctggcgcgggcgacgctggaggcgatctgctatcagagccgtgacgtggtggacgcgatggcagcggattctggtgtgcgccttgaggttttgaaggtcgacggcggcatcaccggaaacgacctgtgcatgcagatccaggccgatgtgttgggcgtggacgtggtgcggccggtggtggccgagaccaccgcgctgggcgcggcgtacgcggccgggctggcggtggggttctgggccgacccgggcgagctgcgggccaactggcgcgaagacaagcgctggacgccggcctggagcgacgagcagcgcaccgcgggttacgcgggctggcacaaggccgtgcagcggaccctggattgggccgacgtcacgtgacgtgacccgatccagggcccgctcaaggcaactcagtcctcgccgagaatgccgtagatctcgcgccgcgcattgttgaggatgtcgacgatgcgctgctgttgctcggggctcgcggtgtgggcggactgcccgaccgcgccgaacaactgaccgatggccgcccgcaggttcatgtgaccggggtcggcgccctcggcgatctcgtcccacggcggggtctcaatcttctccgcggccgcgcgcccgtcgtcggtcagctcgaaaagcttcttgctgccgtcggtttcggtcgcggtgatcaggccctcgtcggcgagcagctgcagcgtcgggtacaccgagccggggctgggcttccacagcccgttgctgcgttcggcgatcagctggatcatctcgtagccgtgcatcgggcgctcggccagcagtgccaacacggcggcgcgcacgtcaccgcgcttgccgcgacccgggccgccacggcgccatgcgccgcgcgggccgcccggaccgaagccgaagcccggtccgaacccggggccgaagccaggcccgaatccgggaccgaagcccagcggtccgtcgtggccgccggcgtgctcgcgcagatgttcgcggaaatcccgccgggcttggcggcgcgcctcgtgcagggcgcggcggtcaacccggccgggcccgaagccgaagccgaagccggggcgggcgccgaagggtccgtcggggggagtgaaggggttgctcatgttttcgtccttacgttcgtgggtttgcgcaccggacgtgcgcttcgaaacatcacgatatatcgaaactaacgcgatgcaacgggatatgttgatcggatttggctgcagccccctgaactgcataaacggtccacaacccgggatctcctcggccgcccgacgcggtttgcacccggcagacggcgggtaggaacacacagatggacgcaaacgacaagctcacggtcgacggcggagctgcgggtgcggtcgcgtccgggcggcccggccgccccgggggccgcaacgtgtggccgtgggtcaactggggactggcgctggcgacggtgcccgccgccgcgatcgtgatgctgttcgcgctcggtgcggtgatgagcaccgacgggtgcagcgaccgcagttgccccaacctgggccacggcgggatcgatttcggcgtcgcgttctacggcgcaccggcggtggccgtcgtcgtcatcatcgtctcgttcttgaccgccaaacgccgcggcggcatcgcggtcccgctgtgcgggtgggcgttgctgatcgcagatgtcgccctgatggccgccagcgtgtccagctagcgcggcggcgtgaagcctgccgaaaacccttccggcggaccgggattcgctggccccggggccggccactgcggtgcgggcccggagccgggccaggccggcggatagccgggtgcgggccagggtgcgggcgggcgcagccgggccagctcgcggcggtgccgttcggcgagcacggcggccagcaccaattccggtggagcgccgggcggcggcggagcgatgcgggccaccacgtcgccggcgatccggtaggccatctgcaggcgcagccccggatcgagttgtgctgccctggaaaggaattggcgggcgacctcggcctggccgctggacagtccggacagctgcagcgacgacgcccaccaggccagcgacggcggcatcgccggcgggggccccagccggggtccgcgttcgttgaccaccacggtgccggcgaagatgtcgccgatccgtttcgccttgggcgacaggatgctgcagatgacggccgggctgccgaacagcatccagatctccaccagcgaggccagcgcccgaaacagcgcttggcggaagcgttccgggccgccgtcgtcggacaccacgcgcagccccagcgcgatcttgcccaccgagcgtccccgcgttgcggtttcgaggatcagcgggtagccgacgatcaccagcaccgtgaagatcagcaggatggcgttgctcagcgcggtgtcgaattgggtcaaggtggcggcccacagcatcagccccagcaggtagccgacgacgatcacggcgatgtcgatcagcgcgctgagcgcccgcaccggcagctgggcgatctgcacgtcgagcaccacggcgtccccggtcaccacctccgacataactggaacggtacaggctgggcggtgagccggggccgggcggactttgcccggaccgcgcggcgattaggctgcccagggtggacgtcgatgccttcgtgctggcccatcgcccgacctgggaccgcctggaccgcttggtcgggcggcgccggtcgctgtccggcgccgagatcgatgagctggtcgagctttaccagcgggtgtccacccacctgtcgatgctgcgctcggcgtcctcggattcgatgctggtcggccggttgtccagtctggtggcgcgggcccgctcggcggtgaccgccgcccacgccccgctgagcagcaccttcgtccggttctggacggtgtcgttccccgtcgtcgcctaccggtcctggcggtggtgggtggccaccggggcggcgttcttcgcggtggtggtgatcgtcgcgctgtgggtggccggcaaccccgaggtgcagtcggcgctcggaactccaagcgacatcgaccaattggtcaatcacgacgtcgagtcgtattacagcgagcatcccgccgccgcgttcgcgctgcagatctgggtgaacaactcctgggtttcggcccagtgcatcgcgctgtcggtggtgctgggattgccgattcctttggtgctgttcgagaacgccgccaacctgggggtgatcgccgggctgatgttcccggccggcaagggcgggctgctgctgggtctgcttgccccgcacgggttgctggagctcactgcggtattccttgccggggcaacgggaatgcggctgggctggtcggtgatctcgccgggcgaccgtccccgcgggcaggtgctcgccgaacagggccgcgccgtcgtgtcggtggcggtgggcctggtggcggtgctgctggtgtccgggttgatcgaagcgctggtgacgccgtcgccgctgccgacgttcgtgcgggtcggcatcggcgtcgtcgccgaggcggcgttcctgtgttacatcggctacttcggccgccgcggcgtcaaagccggggaaagcggtgacatcgaggaagcgcccgacgtcgtcccggccggctgaccggggcgggcgctacagccggccggtcgccttcatcgccaggtagtgatcggcgagcgcgggcgccagttcggccggtgcggcgtcaaccacctccaccccgccgtggcgcagccgggcggcgatcgcggcgcgctcgttgcgggaccgctcggcggcggccgcgtcgtacaccgccgccgcatccgaccgaccggcggccatctggtccacccgcgggtcggcgaccgcggccaccagcaggtgatgtttcgccgacagctgcggcagtaccggcagcaggccctcgtccagggccgccgcgttgaggtcggtcagcagcaccaccagcgaccgccggcgggcccgcagtgcgatcgcggaaaccattgcccgccagtctgtttcgaccagggtaggctgcagcggggccatcgcgtcgaccagctgggcgagcagctcggtgcgcgaggcgccgaagacgccggcccggccgacccggtcgtgcgccaggaagtcgacgtggtcgccggctcgcgacgccagcgcggccagcagcagcgcggcgtccatcgaccaatccagccgcggccagccggcgggatcggcggcggtcgggtcgacaccgacccggcccgccgcggtgcgcccggtgtcgagcacgatcaccacccgccggtcgcgctcgggtcgccaggtgcgcaccaccacgtcggcgcgccgcgcggtggcgcgccagtcgatggagcgcacgtcgtcgccgacgacatactctcgcagcgaatcgaattcggtgccctgcccgcgcaccagggtgggcagcagcccgtcgatctcgcgcagccgggccagccgcgacggcaggtgcttgcgggacaggaacggcggcagcacccgcaactggccgggcaccgattgcgacccctgccgtccggccaggcccagcggcccgatggagcgggcggtgaccaccgtggcccgctggtcgccgcggcgcaccggttccagccgggtcgcgatgtgctggtgttgaccggcggggatgtccaccgggtgcaggcgcggccgggcccgcgcgctgggcggccaggcgtcgcggatctggccgcggaaccggcgcgggccgtcgttgtggatcaacagcgccgcgtcggcgtgctgaccgagccgggccgagcggtcgggggagcggatgtagcgcagccgcgcggggctggccgccagcgcggcgtcgacggccaccgcgaccgccagggccgccagcagtgccgtgaaaaccgttgcgggccaaggggccagggcgatgggcaggacgcagatcagcgcgaccagcccggtgcgtccggtcaggatcaccggggcaccgggaccgacgccagaatcccgtcgagcacaccgtcacaggtggcgccctcgagttcggcctccgggcgcagcatcacccggtgccgcagcgtcgggcgggccatggccttgacgtcgtcgggcgtgacgtaattgcggcccgacagccacgaccaggaccgggcggtggccagcagcgcggtcgccccgcgcggtgacacccccagctgcagcgccggcgaggagcgggtggcgccgacgatgtcgacgatgtagcccagcacctcgtcggcgacccggacctgctgcaccgcgtcgcggccggccgccaggtccgcgggcccggccaccggctggacgacggacaggtcgcgcggatcgaagccgtgcgcgtgccggtgcaggatggcgatctcggcctcccgcggcggcagcgtcacattcaacttgagcagaaagcggtccagctgggcctcgggcagctggtaggtgccttcgtattccaccgggttctgggtcgcggtgacgatgaacggttcgggcagcggctgggcctcgccctcgacgctgacctgacgctcttccatcgcctccagcagcgcggcctgcgtcttgggtggggtgcggttgatctcgtcggccagcagcaggttggtgaacaccggcccgggccggaacacgaacgcggcggtgcgcgcgtcgtacaccaacgagcccgtcacgtcgccgggcatcaggtccggggtgaactgcacccgcttgaactccagctgcagcgccgcggccagcgcccgcaccagcagcgtcttcgccactcccggaacgccttccagcagcacgtggccgcggcacagcagcgcgatgaccaggccgctgaccacgccctcctgtccgacgaccgccttggcgagctcggcgcgcaacgccagcagcgcctctcgtgccgattcagcggtggggctggcggtgaccggttgcgtcggttgcgtcacgggtgtgcgacctgcctttcgatgccgtcgagcgcacgggcaagttgtaacaggtcgtggtcggtcgtcggcggcgggccgaacaggtggtaggagacccagcccggatcggagccggtgcgctgggcggcggtggacaccaccgcctccggggtggcgccgccggccaggccgagcttgggggtcagccgctgcagcgcggcggtgcgcaaggccgcggcggcgcgatcgcgcgcccgccgggaccgatacagccggccgcggccctcgacggtctccgaggcgcgcaccaccaccggcaactcctcggccaccagcggtccgggccggcggccctgccacaccgcgaccagcagcaccaccaccgccagctggccgacgacccagtacacgttggccgggatcaaatccaaaaccgttgccttcgacgaggattcgccctctacgaagtggggcgcgtaccagaccagccggggccggcccccggccaggttcatggccagcgccgcgttgccggcctgcagcaggctgccgttggtcatgaagtcggtgctgcccaccgccgtgatggcgcgtccgccgtcgcggaaccggatcagcgcgccgtcgtagcagcgggtcatcgcccggccgtcttcggattcaaaggtggtggcacgcccgaaccgcaccgacccggcccgaaccgcttcgcgcagagtgcaattcgggtcgctgtcgaagccgttggtccccgagatccgcacgccgggcaacagcgccttgcgggcctcggtggtcggttccaccagtagcagatcggaccggatccgggccagccggtccagcaccgagtcggccaggtactggctctgggccaccaggatcagggcgtccgggcgcgccgcggattcgacgtcggcgatgtggtcggcgaccacgacgtcgactccgccgtcgcgcagcagcgccaccagcgcgtgggcgccgtcgggatcggttgacgccgcgtccatccgggtgccgggccgcggcgcgctcaggtaggcgtccaccccggcgatgacggccagcaccagcagcgtggccagcacccagcgccaggagcgccggcgccgcggcgcggtggcggtggcggtggtcgtcgccatcagcgcacctgggcccaggactcggcgacgacgggttggccgggcggcggtgtgacaccctgccagcgggaccgcaggtgctcgtccaggtcggcgatcagctggtaggcggcctgggttccgggctgctcgccgtaggtgacgtcgttgaaagccgttgcggcttgcgctaattcgccggccagatgcggcaaggcggcgccggcgtcgcgggccagctcgttggcggtccggcccggggcggcggtcagcacgcctgtctcctcgagctggcgggccacggcgcgcagccggtgccggatcgcggccgcccaatcaccttcggcggcgcagctttcggccgtcgcgcggtgctgggcggcggtcagtggggcggcttcgaacaacatgtggtcgccgccgcggcgggtgcgcatggtgcggcgcagggtgtgcacggcgaccaccgccgcgatcgcgagcaggaggaaaagcacggtggcggtgagccatccgcccggaacggttgagatcttctgcagcatccggtagatcgcgtcgttgagccaggcgacgagctggctgggcgtggagcccttggagtagatcggcttgtgcagttcgtccgcggcggcgcggtgcgcggcatcgcggtcgatgtcgatggaaggcatcctgcgctagtcctcgctccgccgttaccggggccgcgtcagccagaggctgtcggtggacgcggccgcatagcttccctgggcggcgccgctctgcagcaccaggtcgaacgcctcggcgcgcatccggcggtcggtgtagagcagcacgatcaccccggcgttgaacggtgcggtgatgatctcgccgatcgccgccccgaccgacaggatcgcggtgctgatcaggaaggccgtgccggacgagctgatctggaagacctggccgacgatgctgaacggcaccgcgacggcgttggcgaccaccgccgtcaccaggaaggcgagcgcccggatgcccagcacccgccagaagccgcgccgcaccagctggaacgagcgggtgatcgcgtcgaggacgggcagccgctccagcacgatgagcaccggggcgaacagcaccacggtgtagaggtacaccagcaccgcgatgacggtgagcaccagcggaatgcccagcaccacggcggccgcggcgttgccgatcgtggccaggatcgcgatgaccaccaccaccagtccggcgatggcggccaccacgacggcctccagcagcgccaggccgagcagggcgggcagccgcccccggatcttggtccaggtttccccgatggtgatcgacgacccgaacaccgcccgcccgacgatgacggtcagcatgccggacagcagcatgccgcccagccagccgaccaggacgccggcgcccaccgacaccgaccaggcgcccagcacgcccgcggtcaactcgtcggatcggtcgccggtgaatctgccgtaggccgccagcgggcccagcacggcggccttggtgatgatctgcatggcgatgacgacgatcgcggtcagtcccagcgtcgccttcggattggcccggatgtagccgacggccccgttgaagatgtcgccgagggtcaacggccgcagcgggatgatgccgggtttgagcaccccgtagcccggcggcgggccgaacgccggtgcggggggatacccgggcggcgggtacgtcgggggcggcccgtagtgggcgccgtaccggccggggaagtgggcgccgtattgggcgccgtattgggattgtgggccgtatgccggtggcggaccaaccggataaccgggcggcggcgcgctcaccgagccccgcggctcgtgcaccggtggttcgtcatgggctccatcctgtcggcggccggaccatttcacaacgttgacccgggctccggcgcgtagcgtcgcacacatggcggaactcaaatcccggctgcgggccgacctgaccgcggcgatgaaagcccaggacaagctgcgcacggccaccctgcgcatgctgctggcggcgatccagaccgaggaagtctccggtaagcaggccaaggacctcaccgacgacgaagtgatcaaggtgctggccaaggaatcccgcaaacgcgccgaatcggccgagatctacacccagaacgggcgcggggacctggccgccaacgagcacgccgaggcgcggatcatcgacgagtatctgcccacccctctcaccgaggcggaggtggccgacgtcgtcgacaccgcgatcgcccaggtcgccgaggagatcggcgagcggccgtccatgaagcagatgggcatggtgatgaaggccgccaccgcgatcgcggccggcaaggccgacggcgcccggttgtcggccgccgtcaaggagcggctctagtccgcggcctcaatccgcgatcagcacccgggtgccgtcgccggcgcggcgcgtcacccgccgggcgtcgagctgctccagcagcggcaccgcgacccgtcgggtggtgcccagcgcgcggcgcgcctcgctgacggtgaacggctgtggcagcccggccagcacgccggcggcgcgggccagcgcgtcgggccccagcaccaccccgtcggcgatccgggtcagccgtccggtccgcaccgccgcggccagctcgcgcgggcccaggcccagcccggcgagttcgtcggcctccggggcgcgaaaaggctcggcggccagccacgcctcgacctcgcgcaccgcctggtcgacgcgggccggcagccccgcgccgggggcgcggaccagcccgtcggccacctcgaaaccggtgccctgcaacaacttcggcaccagctcggcggcgggcaggccgacctgccggcgcagcgtctccagcggcatgccggccgcgatgtcgtgctcacccgcccagcgccgcacctgtgcggcggcctcgtcgcgccgcgccgcccaccactgcgggtccaccacccagtcgcccacccgctgcccgcgcgccggcgcacccatggcgcgcagttcgtcggcccgggcgatgtgcggcgcgggcgccgagccggtggccagctcggcggcgcgcaaccgggcggcgccccgccggcgcagctccggcgggcgcacgtcgagcacctcgaccccggcggcgatccggtgcttcccggggtcgcgcagcagcccgacgtcggccacccgcagcggcagcggccgggccagccgcagccgcgccgccgccgggcccagccggcgcactcgcaccggcaccgctgccgacccgacgtgcagcacgagttggctgtgcagcgtgtcctcggccgtgccggggccgcgcagggcgacgtcgatctccgcggtgtcgcgccacgcgcccggggtgcgaacggtgtcgccgcggccgatgtcgcgccggtcgacaccgcgcaggttcagcgccacccgggccaccgcgccgacctgaatctcgttgcggcccaaggactgtagcccgcgcaccgtgacgcgtcgcccggcgtgttcgagttcgtcgcccacccgcacggtgccggccgccagcgtgccggtgaccacggtgcccgcgccgcgcacggtgaagctgcggtccacccacagccggacgtcggcgtgcggatcgggcggcggcagccggtcggtcagcgcgaccagttcggcgcgcacccgctcgaggtcggtgccgatcgcgacgggaaccccggccagcgaggtggcggcgaaccgttccgtcgcctgcgcgacggccgggcccggatcggcgagatcggccttgctgatcaccagcagcccgtgccgcacccgcagcgcgtccagcgccgccaggtgctcctcggactgcggcatccagccctcggtggccgccacgacgaacaccacggcaggcaccggccctacgccggccagcatgttggccacgaaacgctcgtggcccgggacgtcgacgaaggcgagccgacggccggcgagctcggtccacacgaagcccaaatcgatggtcaggccgcggcgctgctcttcggccagccggtccggccacatgccggtaagccggtgcagcagagtcgatttgccgtgatcgacgtgcccggcggtggctaggacgaacacgcccgtaccgccgcggccagcagctcgtcgtcctcgggggagaccgtgcgcaggtcgagcaggcaccggccgccctccaaccggccgacgacgggcggccggccggcgcgcagcgcggcggcgtagcgctcgggcagactcactgcggcgctgggcaattcgacgccgggcgcgccgccgccgccgaccgccgcgacgcaatccagcgccaccgcgtcggcgtccgcaggcagcgcggcggccagggactgcgcccgggcccgcagccgcccgacgtcggcgtccaacgcggcggccaccggcggcggcggacccgtcagggtcgcctccagcgccgccagggtcagtttgtccacccgcagcgcgcgggccgcgggatggcggcgcagccgctcgacgagatcgccgcggccgaacagcagcccggcctgcgggccgccgagcagcttgtccccgctcgcggtgaccaggtcggcgccgtcggccagcgtcgaggtggcgtccggctcgtcgggcagcaccggatgcggcgccagcaggcccgagccgatgtcgaccaccagcgggatgtcccgggtgcgcaactcggcggccaatgccgccacgccgaccgccgaggtgaacccggtgacgtggaaattggacgggtgcaccttgagcacgaagccggtctgcggccccagcgcctcggtgtagtcgcgcaggccggtgcggttggtggtgccgacctcgcgcagccgcgcaccggtggactccagcagctccggtatgcggaagccgtcgccgatctcgacgagttcgcctcggctgagcacgatttcgcggcccggcgccagggtcagggcgaccagcagcagcgcggccgcgttgttgttgacgacgtgcacgccgccggccgcgggtaccgcccgggcgagcgcggccagcgcgccccggccgcggcgggcccggcgcccggtggccaggtcgaactccacgtcggtggcgccgcccgcggcgacgaccgcgtccagcgccgcccggcccaggttggtgtgcaccaccacgcccgtggcgttgatcaccggccgcaggctcgacgcggtggcgggcagcgtggcgagcgcgtgctcggcgacctgctcgggggagatcttcccggcccgggcccgctgctgggcctgcgtgatcaccgacttcaccagcgcgcggcccagcacccgctgcgcggcggccagccgcgggtcggccagcagcgtgtcggtgcccggcacccgccggcggggatcactcatggcaggcccgacggagtatggcggaggcggacgggaatcgaacccgccagcggcagcgtctgccgttccacggttttgaagaccgcgccggtcaccagaccggacacgcctccctggaccatggggtcaattatggacgggtgacctaccgactgacgcaatacgctcacggcggcggctgcgcctgcaagatcccgcccggtgagctcgaggacgtggtgcgcgggctgggcgcggccagtccgcgcgacccgctgggggagctgctggtgggcctcgacagcggtgacgacgcggcggtggtgcgcatccggcagggcaccgcgctgatcgcgacgacggacttcttcaccccggtggtggacgacgcctacgactggggccggatcgcggccaccaacgcgctgtccgacgtgtacgcgatgggcgggcgcccggtggtcgcggtgaacctgctgggctggccgcgcgaggtgctgccgttcgagttggccgccgagacgctgcgcggcgggctggacgtgtgcggcctggccggctgccatttggccggcgggcacagcgtcgatgacccggaacccaagtacgggctggcggtgaccgggatcgcggacccgaatcgattgctgcgcaacgactccggcaagccgggcctgccgctgtcgctgaccaagccgctcggcatcggcgtgctcaacaaccggcacaaggcgaccggggagcggttcgaggaggccatcgccgtgatgaccacgctcaacgccgaggcggccggcgcggcgctggccgccggcgtcgagtgcgccaccgacgtcaccggtttcgggttgctcggccacctgcacaagctggcccgggccagcggggtgacggcggtgctcgacgcggcggcggtgccgtacctggacggcgcccgcgaggcgctggcggccggctacctgtccgggggcacccggcgcaacctcgactgggtggccccgcacgtcgacctgtcgggtgtcggcgaggacgaggcgctgttgctggccgacgcgcagacctccggcgggctgctgatcgccggcgagatcccgggggcgcccgtcatcggtgagctggtgccgcgcggcgagcacaccatcgtggtgcgctgagcgggccgataacagatggcgacccgctgcgcccggcttcgccgcgcttgcgatcgccattagggtgaggggatggccccgaaaaaagccctgagcaaggtgtttctggaatggcccgtgctgcgccaggtgcgctcgacggacaaactcggccgcggctcggcggtgacctccaaacacacccgcgcgctggcgccgcgcaccgccaccgccgaccgggtggtgcagagcgtgtgcccgtactgcgccgtcggctgcggccagcgggtgtacgtcaaggacgagcgggtcgtggcgatcgagggcgaccccgattcgccgatctcgcgaggacgcttgtgccccaagggatctgcgagcgagcagttggtgaactcgccggggcggcagctgcaggtgctctaccgcgcgccgcgcgccaccgaatggcagccgctgcagctggacaccgcgatcgacatgatcgccgaccgcttcgtggaatcgcgccgcaacagctggcaggacatcgacaagaagggcaacctgctgcgccgcaccatgggcatcgccgcgctgggcggcgcgaccctggacaacgaagagaactacctcatcaagaagctcttcaccgccgcgggcgccattcagatcgagaaccaagcccgtatttgacacagtgccacggttcccggtctgggagcctccttcgggcgcggcggcgccacccaatcactgcaagacatggccaatgccgactgcatcgtcatccagggctccaacatggccgagtgtcacccggtcggcttccaatgggtggaagaggcccgggcccgcggcgcgcgggtgatccacgtcgacccgcgattcacccgcacctcggcggtctccgaccggcacatcccgatccgggccggttcggacgtggtgctgctcggcgcgctgatcaaccacgtgctcaccaacgacctgtggttctccgaatacgtcgtcgcgtacaccaacgccgccaccatcatcaacgaaaacttccgcgacaccgaggatctcggcggcctgttctccgggttcgatcccgagaccgggcagtacgacacgtcgagttgggcctacgaagaggaggacgacggccggtccggaggcgaaatcgagtcccccggcggcggtcacacccacggcgccaccgccacccacagcgccgccggtgacgagcacggcagcggcggcccgccgctggcgcacgccagggtgcgccgcgacgagaccctgcagcacccgcggaccgtcttccagatcctcaagcggcactacgcccgctacacgccggagatggtcaaagacgtgtgcgggatcagccgggaggacttcgactacctggcccgctccatcgtggagaactccgggcgcgagcgcaccacctgcttcgcctacgccgtcggctggacgcagcacaccctgggcgcccaattcatccgcaccgcaacgattttgcagctgctgatgggcaacgtcgggcgcccgggcagcggcatcatggcgctgcgcggccacgccaccatccagggctccaccgacatccccacgctgttcaacctgctgcccggctatctgccgatgcccaaggcgggcgtgcacgacaccctggccgactacctggccgcggtgggatccaagaaacagaagggcttctgggccaacgccgacgcctacaccgtcagcctgctcaaggcgtggtggggcgaggcggccaccgcggacaacgactgggcctacgactacctgccccgactgaccggcccgcacggcacctaccagaccgtgatgggcatgctggccgacgaggtcgagggctacttcctgctcggccagaaccccgcggtcggttcggcgcacggccggatgcaacggctgggcatgtcgcatctcaagtggctggtggtgcgcgacttcaacctgatcgaatcggccacctggtggaaggacgggcccgaaatcgcctccggggaactgaaaaccgaggagatcgagaccgaggtgttcttcctgcccgccgccacgcacgtggagaaggccggatccttcacgcagacacaacgattggtgcagtggcggcaccaggccgtcgagccgccgggacagtgccagagcgaactgcagttcttctacgaactcggcaagcggatccggcaacggctggctggctcgaccgacgagcgggaccggccgctgctggatctgacctgggactaccccaccgacgagcacggcgacccggacggggaggcggtgctggccgagatcaacggataccgggtcggcgagcccgcggacccgttggcgtcctacaccgagctgcgcgccgacgggtcgaccgccgccggctgctggatctacaccggggtgtacgccaacgccgtcaaccaggccgcgcgccgggtgcccaacggcggtgcgtcaccgagccaatcggagtggggctgggcgtggcccgccgaccggcgggtgctctacaaccgcgcgtcggccgacccggacggcaaaccgtggagcgaacgcaagcgctacatctggtgggatcccgaccagcgacgctgggtcggctacgacgtgccggacttcgtggtcgaccgagccccgggcgcccggcccgaccccgagctgggcggccccgacgcgctggccggcgacgacccgttcatcatgcaggccgacggcaagggctggctgttcgcgcccaagggtgtggtcgacgggccgctgcccacgcactacgagccgcaggaatcgccggtggccaacgcgctgtatccccagcagcgcaacccggcgcgaatcaccttcgcgcgcaaggacaatctcagcgcacccagcgccggcgagccgggctccgacgtctacccgtacgtgttcaccacctaccggctcaccgagcatcacaccgccggcggcatgagccggtggctgccctacctctcggagctgcaaccggagatgttctgcgaggtctcgcccgagctggccgccgaacgcggcctgcagccgtacgggtgggccaccatcatctcgccgcgggccgccatcgaggctcgggtgctggtcaccaaacgtgttgcgccgctggtcatcaacggccacaccgtgcaccagatcgggctgccctaccactggggtgtgggcggcgacgcggtggtcagcggggacgcggccaacgacctgctcggtgtcacactggatcccaacgtgcagatccaggaatccaaggccgggtcgtgcgacatccgcccgggccgccgcccgcgcggcgaggagctgctccggctgatcgccgactaccagtcgcgctcgggcgtcaccgccgagaccggcaacgtgcgggtggacgatgccgtgtgggaaagggggagctgatgggccagctgaccggaccgaccgacccggccgccgacgccggctgggcggatcgcaagccgcgcaagggttttttcaccgacacctcgatctgcatcgggtgcaaggcctgcgaggtcgcctgcaaggaatggaaccgcaacccgcaggacggcgacctcgagctgctgggctcgtcctacgacaacaccggcgcgctgggcgccagcacctggcggcacgtggccttcgtcgaacagggtcgcgaacgcatcgagcaggcacgcgaatccggcagggcgctcatcgatttgggcatgccgaccctccccggcgcggcctccgagccgaccgagccggcggtgccgcacaccccggagttccgctggctgatgtcctcggacgtctgcaagcactgcacgcacgccggctgcctggacgtctgccccaccggcgcgctgtttcgcaccgaattcggcacggtggtggtgcagcacgacgtctgcaacggatgcggcacctgcgtggcgggctgcccgttcggggtcgtcgagcggcgcaacgacgggacctacgcgacaccggcgcaacggccggaccgccccagcgaggagatcgtcaccggcgtcgcgcagaagtgcacgctgtgttacgaccggctgctcgaggacgagatcccggcgtgcgccaagacctgccccaccacctcgatcaagttcggcgaccacgacgacctggtggccatggcgcgccggcgggtggccgccctgcacgcccaggggctcaccgaggcccggctgtacggggccaacgagcacgacggcgtcggcggcaccggctccatcttcttgctgctcgacgaacccgaggtctacggtctgccgcccgacccgcgggtgtgcaccgccgacctgacgaccatgttcaagcgggccgggctggccgcggccggcatggtcggggcggccgtgctggcgttttggaggagccggtgagcacctcggaattcgacagtttccggccgcctgaaccggcgggcggcaagcgccgcaaagacaagcgcggcggccggcgcggggcgggcgacggctcccgcgagatgccgatggtgcccgaggccgagttcagctcgtactacgggcgcccggtggtcaagccggcgccgtggggccacgaggtgggggcgtacctgttcctgggcggcgtcgccggcggctccgggctgctggcggccggcgcccagctgaccggccgggacacgctgcgccgcaacacccggctgaccgccctggccgcggtgctgctcagcctggtcgcgctggtgaaggacctgggccggcccgagcggttcctgaacatgttgcgcaccgtcaagctgacctcgccgatgaacctgggctcgtggattctcagcgcgttcagcgccgggatctcggtggccgccgccgccgaggtggaccggatgaccgggcagcggctcccgctggggccgctgcgcccggtgctgcgcgccgccgagggaccggccggccttcaggcggcggtgctggcgccgccgctggccgtctacaccgccgtgctgctggccgacaccgccaccccgacctggaacgccgcccacgaggacctgccgttcgtgttcgtcagctcagcgagcctggccgcgtcggggctggcgatggtgaccacgccggtgcaccaggccggcccggcccgcacgctggccgtgctcggtgcgctcggcgacctggcggccagcaaggtcatggagcggcggatggacccggtcgccgccgaacccctgcacaccggcgggcccggccggatgctgcgggccagcgaacgcctggtgatcgccggcgggctgggcaccctgctgggcgggcggcaccgggcggtcgcggtggtcagcggcctggcgttggcgacggcctcggcgctgacccggttcggggtgttcgaggccgggctggagtccgcccgccacccccgctacaccatcgagccgcagcagcgccggctggccgcccgccgcgcggccgggatcacgtcggactccatcaccaccgcgggctgagcgcgcccgcgtcgtttgccctcggtgcagccgggtatcccggtgcgcatgacgaattttggctacactttgatgaccgagcagagtggacccaaagagcttgtccggtacgcgatttcggccgaagagcgcggtttcgacttccacgtgtgcagtgaccacttctcaccatggctcacctcgcagggacacgcgcccaacgcctgggcggtgctgggcgcggtggcgcaggccaccgagcgggtcgacctgtacacctacgtgacgtgcccgacgatgcgctatcacccggccatcgtcgcccagcaggcggccaccgtgcagatcctgtccgacggccggttcaccctgggcctgggcagcggcgaaaacctcaacgagcatgtcgtcggcaaaggctggccgaccatcacccgccggcaggacatgctgcgcgaggccatcaagatcatccgggagctgttcggcgggcagctggtggacttcaccggcgactatttccgggtcgactccgcgcggctgtgggacgtgcccgacgtgccggtcggcatcggggtggccatcggcggcacccgggcggtcgacaagttcgccaagctggccgaccacctgatcgccaccgaacccaacgccgacctggtcgacgcctggcacggcgcccgccaggccgccaacctcgccggcggcgggcgggtggtcgggcagatcccggtgtcgtgggaccccgaccccgacaccgccgtcaaacgcgcgcacgaccagttccgctggttcgcgggcggctggaaggtgaacgccgacctgcccaccccggccgggttcgccggcgccacccagttcgtgcgccccgaggacgtcgccgacgccattccctgcggccccgacctggacgcgatcgtcgagggggtccggccgtactgggaggccgggttcaccgacatcgcgctggtccagatcggcggggacacccaggagagattcctcaaggaagccgccgaaccgctgctggcggcgctgcgcgacgcggcgaagtagcggcgaacgagaaaggggaaccgagatgtcaaatgagttgcaaggcaagaagatagcgatcctggcggccgacggggtggaaaaggtggagctggagcagccggcggcggcgctgcgcgaggctggcgccggcgtcgaggtggtctcgctgcaggacggcgagatccaggcgcgcaaccacgacctggagccggccggcacctttaccgtcgaccgcaaggtggccgacgcgtcggtcgacgacttcgacggcctggtgctgccgggcggcaccgtcaaccccgacaagctgcgcctcgacgacaccgcggtctccttcgtgcgggacttcgtcggatccggcaagccggtggccgccatctgccacggcccctggacgctggtcgaagccggtgtggcaacgggccggacgctgacctcttatcccagcatccgcaccgatctgcgcaacgcgggcgcccacgtggtggacgaggaggtggtggtggacggcaacctgatcaccagccgctcgccgaaggacctgccggcgttctgctcgaccatcctggcgcaattcgcgggcgccaccaccggttagccgtcaacacttttcggctggtccgtttgaatgcgatggtttgcgggcattatccacgccaagccgtgagatcagcggcgctccttgtaagggttctcgaaaggccaacagtgacaaccacctaccccgagcccgctgtgttgcccgcccacaatgtctatcagccgcaagaggattcccggttgctggtggacgtgatgcacggcaccggtctgatcccgggacggcgcgtgctggacctgtgcaccggcagcggcttcgtcgcgatcgccgcggcggagatgggctgcgccagcgtcacggcgttcgacaaatgcccgcacgccgtgcggtgcgcccgggagaacgccgcgctggccggggtggacgtcgacgtccgggaggggtcgtggctcgccgcggtggattgcgcgccgttcgacgtcgtggtgtccaatccgccctacgtgcccaccccgcccggcgccgtgctggacgagctcggcccggtgaccgggccgtcgtgggcgtggaacgccggccgggacggccggctggtcctggatccgttgtgcgagtcggcgccgaagctgttgcgcgacggcggatcgctgctgctggtgcactcggcgctggccggtgtgcagcagtcgctggattgcctgaaatgggccggaatggatgcgaaagtcattgcctccaaatggatcccgttcggtccggtgatgttgtctcgggcgcactggctggaggacgtcggcctgatcccgcgcgggcgccgcgaagaggagctgatcgtgatccgggcggaaaagcgatgagccccactagggttcaggtggtgcccaacggaccggtgctggtctcggggccggtgcgcatcgagatgcccggcggcgaggtggtcgagtcggaccgtttcatggtggcgatctgcacctgccggcgcagccgccgatatccgttgtgcgacaccagccatcgccgatgccgccagctcaaggactcggccggtccagcggccgccgcaacgacgaccgaccctgctgccacgacgccatgatcgtgtccgccaggcggtcctcgaccgccgcgtgcgcgcggatcccgaagacgacgtcgcgctgcagctccggttcgcgcgccaccagatcgccgaccacatcgaggcgcaccacctgctcgtgcaccgcatccgcctccacgtgctcgctgtagaacgtgatgcaggccggcggcgcctgcatgcgttgcagggcgcgcaccatgcgcgccgatcccggcggggaggtgatctctgctggtgcaggcgcgggccctggccggcgccgtactcgtcgaactcgaccgccacgaacgccgccttggcggtgcccgtcagccgggggatggcccaggcgtgcaggtcgccctccttgaggtgatacagcgagcggtgcacgaagtactcgcacatctgctgccagctgccgcggtcgcgcaggtgatacgacgggccggtgccctcgacgggctcggccgcgatcgcgtccatctcgtcggccgccgtccggtcggggtcgatgggtccgacgtcgcgacgcacaccggccaaaaacacccgttccagctcggcgcgcagcgccagcagcgccggattccactcccatgcggggtcgacgccggtgaagccgcggtagtgcagctcgtagcacatggccagggccagctgcagatccagcccgtacgggtcggagtcacgcaccgacgcgccgatgcgcgccaggtggtcgacgcacgggggcccggtcagcgcgcagcggacggccgtcgacagcggcccgtgcgcggacggcaggacgggttgcgtcgggatcgatgtgcgggtcacgccggtgactacccgtttcggaagccggttaatcgaagccggtcattcggcgggccgccggaacgtgatgtcggcgacggtgccggtggcgctggtccgcagttccatggcctggctgagcgctttcatcagcggcaacccccgcccgctgttgaccggattggccgccggcgtcttccacgaaccgtaatcggtgatgcgggtgtgcacttcgccctcgcccaggcgggcgtcgagcaccatggtgccggcgacgaaaccccggtaggcgtgctcgacgcagttggtgcaggcctcgttgaccaccagcacgatgtcggcggccaactcgccggtgatgccggcggcgcccagccagtccgccagtcggtgccggatgcggaccaattggtctgcggtggcggcggtttcgatgcgcaatggtgactgctgatgccggtagatcaccatcgccacgtcgtcgtcgtagcccgcggccggggccagctcgcgcagcacctcgtcggcgacggtgtccaggggcagcgtcatcgtctgcgccaaaacctctgccgcacggccgattccgtcgtcgatcggctcatgcttgcgttccaccagcccgtcggtgaacagcatcagggtcgacccgggcggcagcaaccgggtggcctgcgggcgggggtcctcgcggcgcacggccagcggcaccgaggcggcgtcggtcaacagggtcgtcgtcccgggctccggtccggccagcacggccggcatgtgcccggcgttgctgtactgcagcacgcccgtctcggtgtccaggatcgcgagaaacacggtggtgcagtaggcattcgggatcagcgacgccgccgagtcgagctgatcgagcagcaccgcgggctcggcgccgttgatcagcagcgcccgcgcggaactgcgcagctgtcccatgatcgccgccgccggcaggccgcggcccacgcagtcgccgaccacgatgccgatccggtggtcgccgatcggcagcacgtcataccagtcgccgccgatctcgagcggcggcaccgcgggctcgtagcgcaccgcgaatccgggtgggggctgcaccggcggcagcatggcgcgctgcaacgtcagcgacgtctcgcgcgcgttctcgaactggcggacgtgctgcagggccaggctgaggtgcccgatcagcacggtgaccagcagccggtcctccccgctgacccagcgcggggtgcgcaactccagccacaacgccaggtccccggccccggagagcaccgcgaccaatccccgtgatttgcccggattatccgggtgatcaacggttttcgccgtcaacggcagctgatggcgcgcctcggcgaaggtgtcgcgcagccacggatccagctcgcgccacgacgacgccgccggccggccggccacctggaccgccgggtcgccgtcgccgctgggccaggacaccgcgaccacccgctgcacgtcgatggccgtgctgcactcgtcgagggtgatggacagcagctcgtccacgctcttggccaccgccaccgcggtggccagccgcagcaccgcgctctcccgggcggcgaaggcgcgctcggcggtcacgtcgcggatggtgccgacgtaggcgtcgcggtcgctgccggaatccttgaccgcgttgatgctcaccttcacccaggccagatgcccgtcggcatggcgaatcggtgtctcgtactcggcgctgccggtgcgcagcacgacgccgatctgttcgctcgcggtcttggggtcgaccagccacgggtgcggccaccggtagggcaggccctcggcggggaacccgaggatctcgatgaaggcgttgttcacctcgatcaccgaaccctcgtggtcggcgacgaagaacccttcctgcaacgaattcaccagtgcgttgcggaatttgtcgcggtcggccagcccctcggcgcgggcccgctgctcggcatagcgccggttgccgtcgatgaatccccgggtcgcgacgtccagcgggaccagcagctgcagcaggaactccagtgcgatcggcgcgtcgatgcgcacgtcctgcgagatctcgaagaccagccggacgtgctgctcgatgatctcgagcaggctgatctgctcctgcagggcgcggcggcccagctcgtgcccgaccgccaggctggcctcgtcgcggctcgccagataggcgcgcagcgcgcgggcgtactgatcgtgaaagtcgttgtcatcactcatgtcgaggctccccggtgccgggcggccagcaccatggcgtcgtcggtctccttggcgtccttgcccagcagaccttcggcgatggccagggcgggggcggcgaagtcgatgtggtccaggtattcgtcccgtcggtgcgcatcaccagcaggtcgccgggccttatcgaaacaacttgcgccggccggatttccggtatccggtagccgacgatgcccccggccaggcgtgcgctggaccggacttcggtgccggtgggcgccttggccaccagatgcgcggtgacgttgccgaccccggtccaggtcagcgtgttggccgcaaagtcgatccgcgccaacgtcattgccacgccccgggtgccttccagcgcgcgatggcagagctggatcaagacttcgatgggttcggcgcccgcggcggtcaccgtgtcgacggcgcgcagcgcggcttccgccgcgggcggcccgtgaccgagaccgtccaccagtgcgaacagcgccgcctcgccgtcgatgtcgatggcgataccgcggtcgcccgaggtgtattcgctgggcaaaggccttccggcccttgcccattcgatgggtccgaaccggccgctgtcacgcacgaggggggacccatttccacatttcgatgaccgttccctggcccagggtggactcgacgaccagccggtccatcaggcggcgggcgcccggcaggcccatgcccagcccgcggcccgtcgagtagccgtcctccatcgcgcgttcgatgtcggcgatgccgggaccctcgtcctcggcgcgcaccaccagcgccttgcggccctcccggtcggcgacggcgacccggacggcgccgcggccggcgtaactggtgatgttgcgggcgatttcggagatcgccgtggcgatcatcgtgacgtcggtcagggagaatcctaagtcaagtgcgagctggtgtccggctttgcgggcttcgacgatgtcgtccgggttgtcgatggcgacgacgatatcagccgccaccgtcgcgcccgatcgtcggtttccgttgcgccagttggcgattcagtagcgcgatgccctcttccaggtccagcgcggtgttcatgtcgtcgaaggccagacccagctggaccatcgcgaaggcgacctcgggctgcagcccgacgatcaccgtgtccgcgccgcgcagccgggtcatgtgcgcgatggtgcgcagcgaccgggccgcgaacgaatccatcacgtcgatggcggtgacgtcgacgatgatgccctgcgcgcggaaccggctgacccgctccatcaggtcatagcgcagccgttcggcgtcggagtcggacagcgccgcctgcaccgaggcgatgaggatcgcaccctgtttcaggatcggtacgggcatggggcgctcgggttcctaaccgtcacccggtttgctcgccggtacgagtcacctcgtagcccaggagccgctcggcctcctcgatgccgccctgcaggtcaccgacggcgttcatcttggacagatccagaccgatcgtcaccagcgtcagcgcgatctccgaggacaggccggtgatgatcacgctggcgcccatcagccccgatgcgtccaccgtctgcaccaggtggttggccaccgtggagtcgatcgtcggcacaccggtgatgtcgatgaccaccaccttggcccggttggcgcggatggcccgcaacagctgttcggtgacctggcgggcgcgctgcgaatccagcacgccgatgatcggcagaatcagcagctgctcgcgcacctgcagcaccggcgtggacagctcgcggatcgcctcctgctgctggcggatgatgcgctcgcgttcctgcacgaacgacacggccacggtgttggcgatccggttggccgccggctcgtaggcgtcgagcacccggttcagcatctcgaactcggtctggtacttctcgaacagcgagcgggccagcacgtcgcgcagcagcagcacgatcccgaccacctcgtcggtctccacgccccgcgggatgatgcgttcggacaggtcgcgcgcgtaagcctgcagcgcctcgacgctaccggtctcgagcacctcgacgtagttgtcgtagacggccgtcgcctcggagaagagctcctcgggggtcatcgcggtgagcaactcggcctcggtgatgcggcgggcccactcctcgcgcaggatggtccgattctgccgcaggtgttgaaccagctgcgggagcagcccctcgctggagataccgacggtctgcgctgcggtgccggtactgttgaaatccgacggcgaatctgacatatggcctcccaaggccttccgagccgagtcgcgccccgcggtgcgcagttgccttttgcgagactagcctggcttgtcgcggggcacgtgtagagggcatattcttctcgcagttcgccaatccaggctagggttgaaccacgccacggtcccgggacaaaggattgccattgtcagctcctgattcgattaccacgttggttgaggaccacgacggggtttccgtggtcagcgtcagcggagaaatcgatatggtcacggctccggccctggaacaggccatcggcgcggtcgtcgcggacagcccgccggcgctggtcatcgacctgtccgcggtggagttcctgggctcggtcgggctgaagatcctggccgccacctacgagaagctgggcaaggaaaccgggttcggcgtcgtcgcccgcggcccggccacccgcaggccgatccacttgaccggcctggacaagaccttcccgctgtatccgacgctcgacgacgcgttgaccgcggtgcgggacggcaaactcaacggctgacccccggcgtcggttggcggctatggattcggttggctgacaacgtgtctggcggagacgtcgacgatccgcaggaagaccagcggtgggaccgccgcgaacgcggcgagaccgaagtgcaacggctggaccgcaattggaacagcctgctgcaggagctgcgggtggtccagaccggggtgcagctgctgaccggctttttgctgacgctgccgttccagcagcgtttcgacgtgctgggcccgccgatgcgggtcgcctacctggccaccgtggtgttctcggtgtgcgcgacggtgttgctgatcgcgccggtggccatgcaccggatcctgttccgccgccaccggctgcaggtgctggtctcggcggcgcaccgatgcgcctacgccgggctgggcgcgctcggcctggcgctgatcggcgtgaccaccatcatcttcgccgcggtggccgggcggaacgtgggcctggtcgccggggcgtgtgcgctgccgctgttcgtgctgttctggttcgtgctgccgctgctgctgcgcacccgcggcatgtgacggccgcgggggctcagccgccgcgcgccagcgcggcgatccgggtggactccaggtgatcgagcaggtcctgcgggtcggcgaagaccgggtcggcgccggccgcccgcagctcgtcgcgggcgatgccgccgctgcacagcccgatgcacgccagcccggcgccccgcgcggcgtgcgcgtcccagacggcgtcgccgacgaagatggcctcctcggcgcgcaccccggcgcggtccagggcgacccgcacgatgcccggctcgggtttggcggtgtcgacatcgcgggacgacgtggtcgcggcgatgacgtcgtcgcagtcgagcaccttgcgcaggatctccagttcgtcctcgggcgccgagctggccagcaccacctgcagtcccaggtcggcgacccggcgcagcagggcccgcgcccccggtagcggcttgagcatcggcgtcagctcccggtagtagcggctgtgcttgtcgcgcagccgctccccgacgtcgtcgggcgcgtcgccggacagcgtccgcaccagcctgctgccgtccatgccgatgcagcggtggatttgccaggacgcgacggcgatgtcctcgtcgtcgaacgcgcgctgccaggtgtgcacgtgcaggtagttggagtccaccaggcttccgtccacgtcgaacaggacggcgggcgcacccgccccggcgctcagcgcaggctccgcggtgtcatgcatccggcatacccggcacgggcccggctgacacgccggcgtttagctccccggacggcgggtacgcactgcggagatccgccctgatgccccgagtaccgctgtgccacgcgaataccgctggcacacaatgattctcgacgaggaatgacgttggaccaccgcaacagcgacccagtcgatcacgcgcgcaccttccgccagcacgccggcgaaaccttcacctacggcgccaatgtgcccggattggccggttcggcggtggcggtcgtcgccatgaccgtcggcgtgttcgccgtggcggccggacacctgaccggcggcgccatcgccctgatcgtggccgcggtggtgggcgcggtgagcgcgggctggctgctgcgcacccaccgcaaggtgcgcgaagccgaactgcgctggcacgccgcgcattccgaccggccgccaccgccgcccagcagctgagcggcgccgggtgaaatttctgcgccgaatcggtgtaaggcgtgcgcggacggggtactgcctgcgccacgggtgaggacagcgaaagtgcgtcaacccgttccgagcaggaaggaactccgatggcgaccaccactgactacgacgcacgccgcgtatccgacaacgacaccccggacaagtcctcgctgcgcgagctggcacccgccctgcacggggccggcaccaccgtcgtcgacgacgaccccgacgacgtccacttcttcgaactccccggcgccgacctgtccggcgaagagctgtcggtgaccgtgatcccgcagcgcgccgacgagttcacctgctcgagttgctttttggtgcagcaccgcagccggttgcggcgctccgccgccgggctgccggtctgcgccgactgcgcgtaacacgcggcgacccgccgtccccgccccgggcggctgcgccgatttgtcacacggttgcgctacgttttcggcaaagccggccgcgtagacgttgaggggtcatggacaaggcactcggggcgctgctcctgttggggctgggcgtgccttggtatttcacccaacacgccaccggcagcctgcccgcgggttgtgcggccgggctggccggcctggccgcggcggtcggcgcgctgtggtggctttccctgcagcgggaccggttgcgggccgatgcccaccgccgccgcgacctcaaacacgcccgcgcggggttgcgtgccatcgaccggatgtccggcgcggagttcgaggacttcgtcgccgcccagctgcgcgtcgccggctacgtcgtcaccccgacggcgggcacgggcgactacggggtggacctcatcgccaagaaggacggcgtccgcatggcggtccaatgcaaaaggctggcgaaggccgtcggggtggccgccgtgcaacaggtcgtcgccggggcacgccagcacggctgcgaccgcacggtggtggtgaccaatcagacgttcaccaaggcggcccgccggttggcgatcacccaccgctgccggctggtggggcggacccagctgcgcagctggacgcgggtcgcacccatcccggtgcggggtccgcgggtgtcgtgaacgccattgcgccacaaagacttacgcgatttccggcacccgggccgcctcatcgttgggtggtgtcgtcgatgacgcggcgggcgatgtcgcgcagcggggtgttcatgctctgcgagagtttgatcagcgtgttgaacgcggtttcgtcgtcgagctcgtagcgttccatcaggatgcccttggcctgtccgatcatgtcgcgggtgctcagcgcctccttgaactgctgggttcgcaccacgttgctccacgccagcgagcccagcgtggcgaacagggcggccatccggcgggagtcgtccgagaaggcgtgcgggcgttcggcgtagaagttcagcgcccccatgctcagctcgccggcgtacatcggcagcgacaggatgctgcggatcggggtgcgcgccagggcgtcggcctggtacttgggccagcgtgagtcggtccgcaggtcgtcgaccaccacgaccttgcgagtccaggcggcatgcaggcagggcccttccagatagcgttgctggaactcgtcgagcagccgggcgcaatcgtcggtgaccgagggcgtgctgacctcgttctgccggctggtcaccgtgatcccggcctcctgggcgcccggcacccaccgggccgacgcggcggtcaggtcgtcgaggacctgcggaaaatccgcggtgtccgccgagtagatggcgcgcagaacgtcgttcagcagggtgagatcgtcaaaattggtcactgagtgtcgccctcatgagttcgagaccggtggcaggcaatacccgtgccgttttgagcagcctgcggtcccgcgaggcaatcacgtgcagtgtttgacggcgacgaatgtcaatgctgtttgctcagcattacggtgagatccactatatcgccccgtgttacggggatgttcgcacccggcaccggcccgtccggcaatccgcttccgcgggcggcgtcgactggtagcgtccggcgcaccggcccgacctgggagcgacgatggtggcaaccgaacacgagtggagcaaacccgcggccctggccattcccagggagggctacttcgagctcgaacgcggtcgttacgggccgctgtatccccgcaccccggcctgctacggcttttccatcatcgccaaggtcaaggagggccgcgaggaagccgtccgcgcctacggcaaacagatcgaagaggccatcaaggccgatccgcacgtgcttgccgcgctgcggctgcactacctgcgctggttgctcttcgacgtcggatcgggactgcacttccagtaccagggcatcttcgacacggacttcgacaagtacaccgaggacgcggtgcagctgttcagtcagaccgggatcaccaccgtcttcacgaacctcgaggggtttcccgaagactggcgggagaacccggacgccttcgtcaagttcgtgcgtgagcaccagtgcccgagctttctggagtacggggagtatccctacgtcaccgccgacgagatcaaaaaggcgttacggctcaaggccgccttccagaccatgctggatcagatgcaatgacgtcggtcagagtctgagatgctcgagctcgacgacatccagcacatcctgctgacccgaaccccggcgctgaccggacgctacgagtttctctcgttcgacgatgcaaccgccgggcgggcgtggctgtccgccctcgtcgatgtcgtgcagtccgcggcgtcggtacgcgacaccatggacagcgccaagcgatgggtcacgctgggtttcacctggaacggcttgcgggcgctcggggttcccggggacgcccttgccagctttccggaagagttccgccagggcatggccgcccgggcggacattctcggggacaccggacgcaatcatcccgacaactgggtgggcggattggccggcgcggacctgcacgcgatcgcgattctgttcgcgcgagacgacgccgaacatgcccgcgccaccaacgcccacgacgacctgctgaaaaggtgccaaggtgtgcgcaggttgtcacacctcgacctgaacgcaacgcctccgttcaactacgcccacgaccacttcggcttccgggatcgcttgtcgcagccggtgatcgaaggatccggcgaggaacccacccccggctcgggcgcgccgctcaaggccggggaattcatcctcggctatcccgatgaagtcggcccggtggccaatcagcccgagccggaggtgctgtcgcgcaacggaacatatgcggcgtaccgccggctgcgcgaacacgtggccgtcttccgcgactacctccgttccgtggccggcgcggatcggcaggaggagttgttggcggcaaaactcatgggccgctggcgtagcggtgccccgttggtgctcgcccccgacgaagacgatcccgagttgggcgcagatccgctgcgcaacaacgacttcaactacaaggagatggaccccttcggctacgcatgcccgctgggcgcccacgccagacggctcaacccgcgagacaccgcgcacaacatgaaccggcgccggatgattcgtcgtggggcgacctatggtccggcgcttcccgaaggcgctcccgacgacggcgaggatcgtggcatcgccgcgttcattatctgcgccagcctgatccggcagttcgaattcgcgcagaacgtctggataaacgaccgcactttccacgaactcggcaacgagcacgacccgatctgtggaacccaggacggcacactggatttcaccataccgaagcgaccgattcgccgggtgctcaagggactgccggcgttcacgacgctgaccggtggggcgtacttcttccttccgggcatcaacgccatgcgatacctcgcggcgctcggcgaacggtcatgagcacccggccgcccgcgcgcacctacaaccaagctcaccgggtgcgcccgcacaccggcggacggcggatcagcatctactggacgtggagctatccgtgggaatcgcagcgcgacattcagaccctggacaaccgcttctccaccatgaccgaagtgcgcagggcggcctggccccgatacgaggggcccgactgggacgacgcccactttctgcagggcatcgccggcaccttggagcttttccaccgctcgacgcttgcgttccaggagctggccggcgaagcaaccggtcagcaggtggcggtgttccagcgcgtcgaccaggccggctaccggctggtgatcgacgagcggatattggccgacaccgacaccctgatggtgttcgggctggaccatctcgccggggaagacgaggccgagcccggggagatctcggccatccgtgcctggctggaacgcgagggcacctgcctgctgctggccccgcaccacgacgtcggcggcaccgacgacatggcccagcggcaggtcgaatacctgcaccacggggatccgctcgtgccgcggcaacaacggttttccgcctacacccgctcgctgatgaaggggctcgacgttcccgtccgcaacaggtggggcctgcatccggcccgggtggccgcgaccggtcagatggcaccgctgacctgctttcgcgacctggacgcgcccgggctgctggacgatgtcacgacgctgaactttcacccgcatctgccgcactacgagctcaccgccccggaaagcgacgggctacgggtgctggccacccaacgcgtcgacccggcccggccccatccctttaccgaggcgggcaacagcgaattcaacgcgttgatctggatgccgccgcacgccgaacgagccggtgacatcgtgctcgtcgactcgaccaacttcacgacgctgttcggcgggtccgacagcctcagaaacttctggcacaacctggccacgatgaggtgaaggacccgccgctcacacgagtcggggtggcgggatttgaacccacggcctcttcgtcccgaacgaagcgcgctaccaagctgcgccacaccccgcttgaagctccgacagcctatcgcacagggctggcggctggccaaaccgcggtgtgccgggtcactgccacgcgcagctgcgctcgaattcggccagcgccgcggccgatccggccggatccagcccctgcgccgccacccactcgtcgtcgaagtaggtgtcggcgtaccggtcgccgctgtcggcgagcagcgtgactaccgaaccgccgcggccctgcgacaccagctcggccagcaggccgaacgccccccacacgttggtgcccgtcgagggccccacccgccggcccagcacggcgctgacgtggcgggcggcggcgacggaggccgcgtccggcacggcgaccatgcggtcgaccacgccgggcagaaacgacggctcgacccgcggccggccgatgccctcgatccgcgacgaccgggacgccaccacgtcgtcccggccttcggcgtaggccgcgaagaacgccgagtgctccgggtcgacgacgcacagccgggtggcgtgccgccggtagcggatgtagcggccgatggtcgcgctcgtcccgccggtgcccgctccgaccacgatccaggccggcacggggtgtttctcgtcgcgcatctgctcgaagatcgactcggcgatgttgttgttgccgcgccagtcggtggcccgctcggcgttggtgaactggtccaggtagtgcccgccggtctgccgggccacccgctcggcctcggcgtacacctggctggaatccgcgacgaaatggcaacggccgccttgtgattcgatcagcgccaccttggccgcgctggtcgactccggcatcacggcgacgaacggcagccccagcagggccgcgaagtaggcctcggacaccgccgtcgaccccgacgacgcctcgaccaccgtggtgccctcgccgatccagccgttgcacagcgcgtacaggaacagcgagcgcgccagccggtgcttgaggctgccggtgacgtgcgtcgtctcgtccttgaggtacagcgcgacgtcggcgtcgccggcccaggccgacggcagcgggtagcgcagcagatgggtgtcggcgctgcgccgcgcatcggcctggatcagccggatcgcgttgtccgtccagtcgcgtggcaggttgcggaccgcgatccgggtccgcgtcaccgcaccgaagctgttggctgcgaacggctcaggtcgctgaccgcgtcgcggtcgcccatcggggtggcgatcagcgtcagcagggtggcctccggccggcagcagaaccgcaccggcgcgtacggcgaggtgcccatgcccgcggagacgtgcagctgcatgtgcgcgccccagcgggacggccccttcgcgcgcgagcggtccagcccgcagttggtcaccagcgccccgtagaacggcaggcacacctggccgccgtgggtgtgcccggccatcaccagttggtagccgtcggcggcgaaccggtccagcacccgcggctccggcgaatgcgtcagccccagccgcaggttggccgccgggctggccggccccgcgatggtgtcgtagcggtcccggtcgatgtgcgggtcgtccacgcccgcggccgcgacgtgcaggcccgccacctcgaactcacgccgggtgtgggtgaggtcgagccagccgcgctcggtgaacgcggcccgcaggtcctgccagggcagcggctcgccgcggacgcggtgcgacgggttggtgacgtagttcagcgggttcttcaggtgcgggccgaagtagtcgttgctgccgaacacgaagacgcccggccgcgacagcagatcccccagcgcctggatgacggccggcacggccttcgggtgggccaggttgtcgccggtgttgaccaccagatccggttcccagccggccaactcgcgcagccacgcctgcttgcggcgctggccgggcgtcatgtgcaggtcgctgatgtgcagcacccgcagcggtgtcgagcccggactcaacacgggcatggtgatctcgcgcagcacgaacgcgttgcgctcgatgatcgcggcgtaccccaggccggcgaccgtcgaaccgagcgccgccgcgccggtacgcaacaggatgggcagggctcggcgccggccgcgaggcggccaggagcggcgccgggcaatcgagacgtgagcatcagccatgaatcgcagcctactgccggtcgccgactggccgcgtaacccgcgcgtcacggcccgttacggcggcggttgcccgggcgccggcggcggcggcgccagcagcggaatggtgatcggcggaagccccggaatctcgaccacctgcgaaccgaccggcgggggcgcgccctccggcggtggcggcggggccggtgggatgccgttgctgacctggatggtgatgatcgacccgggaatcgtcgcgccgctcggtgtcgtgccgaccacctcgccctgcttggcgctgctgttgacgaagttgttctggtcggcgacctggaaacccgcttccttgatgcgctgccgcgccgcgtcgatgtccaggcccgccacgctgggcacccgcgaccccggcgcgccgtccacgtagcggggatcggtgggcggcaactgcaccggaccgaaattggtggcgatcggcttcatcgcggtgaaccaggtgcgggccggctcgttaccgccgtacaggtcgccctcgccgcagtggcgcagcggggccgaacacaggtccgtcggattcggcgagtcgtcgtagatgtagttggccgccgcgtagtggttggtgaagccgacgaagcccgacgaccggtgggcttcggtggtgcccgtcttgccggacatgggcaggtcccagcccgccgcgccggccgaaccggccgccgtgccgccgcccaccgcgtccttgctcatcgcgttggccatggtgttggccaggccctcgggcaccacctgatcgcaggtctcggtggtcaccgccacctcgttgcccttgcggtcgatcagcttgtcgatcggattgggtgggcaccaggtgccgccggaggccagggtggccgcgacgttggacagctccagcgcgttcacctcgatcgggcccagcgtgaacgagccgatgttctggcgtttgacgaagtcggccaggctctcgttgctgtccgggttgtagtcgcgggcggtgccggggtcggcgtaggagcgcaaccccagcttgatcgccatgtccaccgtgcgcgtcaccccgacctgctggatcagtttggcgaacgcggtgttgggcgaggtggccagcgcctcggtgacgttcatcgagcccttgtagttgccggcgttgaccacgcaccaggtgtctttcgggcagcccttggcgccgccgctccccatgcccttggcctggaaccggcccggcacttccagcgtggcgttgatgcccatgcccatgtccagcgccgcggccgtggtgaagatcttgaacaccgatcccgcgccgtcgccgaccagcgagaacggctgcgggcgcatggtctgcccggcgtcgacgtccaggccgtaggtgcggttgctggccatcgccatcaccttgtgcgacgtcttgccgggctggatcacgctcatcacgctcgagatgccgggcagcgtcgggctggcgaacttgtcgatggccgccttgaccgggatctgcacgtcggggtccagcgtcgtcttgatcaaatagccgccccgggccacctgctccttgctgatcccggcgcgcgagaggtactcctgcacgtagtcgcagaagtacgcccggtcaccggccgcgatgcagccgcggggcagctcgttgggctgcggcaggatgcccagcggcgcggccttggcggcgcgcagcgcgtcggcctcctgcgggatgttctcgatcatggtgtccagcaccaggtttcggcgggccagcgcgccttcggggttggtgtaggggttgagcgcgctggtcgactgcaccatgcccgccagcagcgccgcctgctgccagttcaggtcggaggcgttgatgccgaagtaggtctgggcggcgtcctgcacgccgaacgagttgttgccgaacgacaccaggttcaggtaccgggtcaggatctcgggcttggtgaaggtcttgtccagggtcagcgccatccggatctcgcgcagcttgcgggccggggtggtctccaccgccgcccgcttctcggcgtcggtcttcgcggtcaccagcagctggtagttcttgatgtactgctgctcgatggtggagccgccgcgggtgtcgacgtcgccgcgggcgtagccggccaacccggtcagggtgcctttccagtccaccccgttgtggtcggcgaaccgcttgtcctcgatggatacgatcgccagcttcatcgtgttggcgatcttgtcgctgggcacctcgaagcggcgctgcgaatacagccaggcgatggtgttgcccttggcgtcgaccatcgtcgacaccgccggcacctcgccctcgagcagctgcgccgagccgttggcgaccacttccgaggcgcggttggacaccagtcctattccgccggcgacgggaaacagcagcgcggtggccaccacgctggccaacaaacagaaccccgcgagcttcaaaaccgtgagcgcggccggggggcggtctgacatggctactacagtagcggcccgcagtcacgccgccacgctgcaagttcaccgattaatcgggccgatcggggggccggcggcgcgggcgctgagcagcacgaaaatttgcagttgcgtcagcgatccggatcgaacatggtgtgcgagatcacttcttcgcctatccttcggagcgagacgggacgcccgtcccaaaaaaagcgttatcggactgttgcgcaattggcagctgaccacctaacttagacacacggtgagattcaggtaacaccgaagcacacagtgtggcgtagatcgcaagggttggatctgcaccccaggagggcggtcgcgacgggcgaccggtagggaagggaacagttcgtgtcaccaacacggccggcggcgcgtaggacaaacattgcagccgctcaaggggtacttcgcagtgtcgatgccgaggagcgcatcgcctgggtctcgaaggcactgtgccggaccaccgatccggatgaactgtttgtgcgcggtgccgcccagcgcaaggccgcagtgatctgccggcactgccccgtcatgcaggaatgcggggcggacgcgctggacaaccgggtcgagttcggggtctggggcggcatgaccgagcggcagcgccgcgcgctgctcaagcagcaccccgaggtggtgtcctgggcggacttcttcgacaagaggagaaaccgcagcgccgggtgaccggcgccgccgaccgcccgctgttcgtgattacggtactgttacgcccgatcccgggccgttcagcgggcggttgcctggttcgacgtgatctggtcggccagcgcgcgcagcgcttccaagtccgaaacatcaaacggcagtgagggaacgccgatcaccggcacgtgcgggttggcgccggtgaagcgggacagcaatcggatttcccgcttggcggtctgcgcccgatcggcgtgaatcctcagcacggccgcggccagcgaggtggtttcggggtcgccgtcgtgctcgagcatctcggtgccgtcgatcgcccgctccgcgggcagcgagcacagcggcggatgggtgcggttgagcaccagcccggccagcggcatcccttcctgggacagccggtcgacgaagaaggacgcctcgcgcagcgcgtcgggctcggccgccgacaccaccacgaactgggtgccccgccgtttcagcagcgcgtaggtgcggtcggccttttcccggaagccaccgaaggtggcgtccagcgactgcacgaacgccgcggcgtcggcgagcatctgtgagcccaggatcgtcgacatcgccttcatcgccaaacccattgcgccggtgaccaatcggccgattccgcggcccggcgccagcagcagccgccacagccggctgtccatgaagctgcccagccgtttcggggcgtccaggaagtccagcgcgttgcgcgacggcggcgtgtccaccaccaccagatcccagcgatcctcggccagcagctgccccagcttttccatcgccatgtactcctgcgtgccggcgagtgagctggcgacggtctgatagaactggttgtccagaatcgcttgtgcgcgaccgggtccggagtactggaccaccatctcgtcgaaggtccgccgcatgtcgagcatcatcgcgtgcagctcgccgggaacctcggcggccagcggcactcgttgcggcgtgttgccgaggtcgttcacgcccaacgcctgggccagccgcttggccgggtcgatcgtcaaaacgcagacattgcgcccgtattcggcggcgcgcagcgcgatggcggccgcggtggtggtcttacccaccccacccgcgccgcagcacaccaccacccggttggtggtgtcggccaggatagccgccatatcaagctgtttgggtgtggtactcatcgaactccttgctgggcaagcgattccgatagctcgtagaggctgcccaggtcgacgccgtcggagatcgccgggagttccagtcgggccacgtgcaacgcgtcgagctgctgtgcgatctcggcgcgggtggcgatcaccgtcgcatgctcgatggtctccgtcagcaggccggcgaagtctttgtcgtccaacgtgattccggctttttgcagcccagcccgcaccgcgtcggcgtcgatgtcgccctcggcggccttcgctagatcggcgggctgcaggtaggcgggaatgttgcggttgacgatcacgctgccgatgggcagctgcatctcggcgagttcctcgatggcttccagcgtctcctgcacgggcagcgcctccagcagggtgaccaggtggatggcggtctgctcggagtgcaacagcctgaccacgccgtcggcctgcgagtgcaccggaccgcccttggccagatcggacaccgccttggtgacgtcgaggaagcgggcgatccgcccggtcggcggggcgtcgacgacgatcgcgtcgtacaccggcagccggttcttgtcgacgcggatcaccgtctctttgatcttgccggtgagcagcacgtcgcgcaggccgggcgcgatcgtggtggcgaactcgatggcgccgatgcggcgcatggcccggcccgcgatgcccaggttgtagaacatgtcgaggtattccaggaatgcggcctcgatgtcgatggccagcgcgttgacctggccgccccgctcggcggtcgcgatcttcacctcttgatagggcagcggcggaacatcgaagagctgcgcaatgccttggcggccttcgacttccacgagcagcaccttgcggcccccggctgccagcgtcagcgccagcgcggccgcgatggtcgatttgccggtaccgcccttgcccgtcacgaaatgcaagcgggccttggtcaagcgcgccggccagccgacggcagctccgccgctcgatgtggttgccaccatcgcatgctagcccgaccgggcattggcctggccggagcggttcaccggcgaccgataagctcgcgggatgagccaaccgaccgcatgggaatacgccaccgtcccactgctgacgcacgccaccaagcagatcctcgaccagtggggtgccgacggctgggagctggtgtccgtgctgcccggccccaccggcgagcagcacgtcgcctacctcaagcgccccaagtagatgagcgctgcaccgtcctggaaggcccggctggccgagctcggtctgacgctgccggaagtggttgcgccgctggcctcctacgtccccgcggtgcgcaccggcaacctggtctacaccgccggccagctgccgatgcaggacggcaagctggccgccaccggcaaggtgggcgcccacatcagcccggacgagggccgcgcgctggcgcggatctgcgcgctcaacgcgctggccgcggtcgacgcgctggtgggcatcgacgcggtgacccgggtggtcaaagtcgtcgggttcgtcgcctccgcacccgggttcaacggccagcccagcgtcgtcaacggcgcctctgacctgctcgccgaggtgttcggcgaacatggcgcgcatgcgcgctcggcggtcggggtcggtgagctgccgctggatgcgccggtggaagtggagctgatcgtggaggtcggcgcgcggccgtgaccgaagttgccgcgtcgccgacccatcccgcatacggcaggttgcgggcggtcaccgacacggcctcggtgctgctggccgacaatcccggtttgctgacgctggagggcaccaacacctgggtgctgcgcgggcggggcagcgacgagctggtgatcgtggaccccgggccggacgacgacgagcatatcgcgcggatcgccgcgctgggccgcatcgcgctggtgctgatcagccaccggcacggcgaccacaccgacggcatcgacaagctggtcgggcgcaccggtgccatcgtgcgctcggcgggcagcggctttctgcgcggcctgggcggtgagctcaccgacggcgaggtgatcgacgcggccgggctgaggatcaaggtgatggccacgcccgggcacaccgccgattcgctgtgcttcctgctcgacgacgccgtgctgaccgccgacaccgtgctgggccgcggcaccaccgtcctcgacaaggaggacggcagcctgacggactacctggaatcgctgcggcggctgcgcggcctgggccggcgggcggtgctgcccggccacggcccggacctgaccgacctggaaagcgtcgcgcagggctacctggaacaccggcgggagcggctggaccaggtgcgatcggcggtgcgggagctgggcgaggacgtcagtgcccgccggatcgtcgaacacgtctacgtcgatgtcgatgagaagctgtgggacgccgccgagtggtcggtgcaggtgcagttgaatcacctgcgctcggagccatcgacgtaaccgccttggcgtgagtcactccggccccatgggtcccggccccgaagggacggagtgcgtcagagttccgctagcgccgccgctagcggatttcgaagtcacctgatgggtgacgcggcggtgcagctgaggctgatgtggcgaagctaaacggtccgggcgcttagcgcgcccgggcttagcccgcgcttacctcgctcgccgcgccagccgctcggagtccgagatcagcacgcttttgccctccagccggatccagccgcggtgggcgaaatcggccagcgccttgttcaccgtctcccgcgacgccccgaccagctgcgcgatctcttcctgggtcaggtcgtgggtgacccgcatggcgccgccctcctgggtgccgaagcgctgcgcgagctgcagcagctgcttggccacccggccgggcacgtcggtgaagatgaggtcggccaggttgttgttggtgcggcgcaaccggcgggccagcacccgcaacagctgttcggcgatctcggggcggtcggcgatccacgcgcgcagcgcatcgcggtccatcgacaccgcgcgcacctcggtgatggtggtggcgctggacgtccgcgggcccgggtcgaagatcgacagctcaccgaacatgtccgaggggcccatgatcgtcagcaggttttcccgcccgtcgggcgagcggcgaccgatcttcaccttgcccgagacgatgatgtacagccgatcccccggttccccttcggcgaagacggtgtgtccgcgggggaagtcgacgggttggagctgcttggtcagtgcggtgactgcgctgggctcaaccccttggaagattcctgcccttgccaggatctcgtccacgttgcctcttcaactttcgcaagaaattaatgtgatacgggcaggctaaccccttgctcgcgtgacgagtctagaggaacgccattgtgtctaacgtgccaacgctacacacgattggcgtgtcgaggtgccctaaactgcggattgacgtgcgaatggccgccgatcctggtcggcagcgtcatctcgtcggggtcgacgaagccggcggcgaaggacggcgcggcgtgccgcggaccgccgctgcgcccgcccggcgccggaccggcggattgctgggcctcgcgccggtgcaggtattccagggcctcgggcatgccctcggcggccagcgtgtgcatgtccacgccgccggtgcgctcgaggaactcgtcgacatcggccaccgcggccggatcccggacgagctccttttccagccgccccagtcccagcgccgccagcatcagcagcaccggtacaccggccaccagcaaccacgacacacgaagagtaaacatggccttgcatgaacacgaggtctcggccggatcacgaaataagtactctgtcgtaggtgacaacggctaagtcgtcggggcgtgcgaagtcgaccccggccccgcccggcgacgccgccgcccggcgctggtcgaccgaatcccgagttgccttggtgcgacgggcgcggcggatgaatcgcattctggcacaagcgtttccggaagcgcactgcgagctggacttcaccacgccgctggagctgacggtcgccaccatcctgtcggcgcagagcaccgacaaacgggtgaacctgacgacgccggccttgttcaagcgctacacctgcgcgctggattacgcccgggccgaccgcgacgagctggagaacctgatccgcccgaccggcttcttccgcaacaaggcctccgcgctgatccgtctcggccaggccctggtggaacggttcgacggtgaggtgcccgccaccatggccgagctggtcaccctgcccggtgtgggccgcaagaccgcgaacgtcatcctgggcaacgccttcggtgtccccggtatcaccgtcgacacccatttcgcccggctggtgcaccgctggcgctggaccgccgagaaggatccggtcaaaatcgagcacgccgtaggcgagctgatcgaacgcagcgagtggaccatgctcagccaccgggtcatcttccacggccgccgggtgtgtcactcgcgcaaaccggcctgcggggtatgcctgctcgccaaggactgcccctcgttcgggctgggtcccaccgaaccgccgctggccgcgcagttggtgcgcgggccggaaaccgagcatctgctcgccctggccgggctgtaaccgcgccgacagcacggggaccgcatgcccatcccgaggccgacgctgacccggaaggttcgctggcacatcgcgattctcacggtggtggtggcgctgatcgtcgcgctgctggcccagctgcgtgacgacgccgcgacgcccggcccgccggccaccggccgggcggtggccgaccgcgaacaccgcgacgccgacaccccggccgcgctggccggtccccgacagcgcgccgacctgccgccgtgtccggccgcgggaaccggtcccggcccggcggcgctgcgcggcgtgacggccgagtgcgccgccgacggttcggtggtcgacgccggccgcgcggtggccgggcgccgggtcgtgctcaacttctgggcctattggtgcgcgccctgtgcggccgaactgcccgcgatggccgagtatcaacgacgggccggggcggaggtgacggtgctgacggtgcatcaggacgagaacgagaccgcggccctgctgcgactggccgagctcggcgttcggctgccgaccctgcaggacggtcggcgccgggtcgcggccgcgctgcgggtggtaaatgtgatgcccgcgaccgtggtgctgcggccggacggtagcgttgcccagacgctgccgcgtgctttcagcacggccgacgagatcgcggccgcgatcgggaacgacaggggataagcggaaaaattgaaccgactggaggggccgtgagtgctgggggttcgcccctgcggaatggggaccccgccccggcgcgtgggaccgttccgctgacgcctgacgcctgcccgtcctggctgcgtccgctggtcgacaacgtcgaccacgtccccgacgcggcccggcgccggttgccggccgacgtgctggcgatgatcaccaccaaggccgcgtcggcgctgacgagcgtgcgcggcgccgcgcgggaagccgcggtgctggtgctgttctccggcccggaatccgggccgcccggcgggggcccgcccaccgacgccgacctgctggtcaccgtgcgggcgtccacgctgcgccaccacgccgggcaggcggcgtttcccggcggcgccgccgatcccaccgacgacggcccggtggccaccgccctgcgtgaggcccgcgaggagaccgggatcgacgtcagccggctgcatccgctggccacgatggagaagatgttcatcgcgccctcgcagttccacgtcgtgcccgtgctggcgtattcgcccgaccccgggccggtggccgtggtcaacgaggccgagaccgcgctggtggcgcgagttccgttgcgcgccttcatcaatcccgccaaccggctgatggtgtaccgcggcgacttgggccgccggtgggccgggccggcgtttctgctcaacgagatgctggtgtggggcttcaccggccaggtgatctccgcgctgctcgacgtcgcgggctgggcccagccctgggacacctccgatcagcgggagttggacgcggcgatggcgctggtcggcgagcggggtgacgcactcgaatgaacctgaattcgatgaccccgtcgcagtggctggacgtcgcggtgctggcggtggccttcatcgcggcgatctcgggctggcggtccggcgcgttggggtcgctgctgtcgttcgtgggcgtgctgctcggcgcgatcgccggggtgctgctggcgccccacctcgtcagccacatcgccgcgccgcgcgcgaaactgtttgcggcactgttcttgatcctggcgctggtggtcatcggcgaggtcgccggcgtggtgttggggcgcgcggtgcggggcgcgatccgcagccggtccatccgcaccgtcgactcggtgatcggggtcggcgtgcagctggtggtggtgttgaccgcggcgtggctgctggcgacgccgctgacccagtccaaggatcagcccgagctggccgccgcggtgcgcggttcccgagtgttggccaaggtcaacgaggttgccccgccgtggctcaagacggtgcccaagcggctctcggcgctgctgaacacttccgggctgcccgcggtgctcgagccgttcagccgcaccccggtgatcccggtcgcctcacccgatcccgagctggccagcaacccggtggtgcaggccaccgcgcccagcgtcgtcaaggtgcgcagcctggcgcccagctgccaaaaggttttggagggcagcggattcgtgatcgcgcccgaccgggtgatgaccaacgcgcacgtggtggccggttccaacagcgtgcagatctacgccagcggcaacccgctggacgccaccgtggtgtcctacgacccgtccgtcgacatcgcgatcctcgccgtccccaacctgccgccgccgccgttgccgttcgcccagaccgaggcgaaaaccggggccagcgtggtggtgctgggttatcccggcggcggcaacttcaccgcgacgccggcccggatccgcgagctgatcaagttgagcggacccgacatctaccgcgacccggcgccggtcacccgcgacgtgtacaccatcagagccagtgtggagcaaggcaattcgggtggaccgctgatcgacctgaacggccaggtgctcggcgtggtgttcggcgcggccgtcgacgaccccgacaccggcttcgtgttgaccgccgacgaggtggccggtcagctcgccaagatcggcgagaccaagacggtgggcaccgggtcctgcgtcagttgacggccgggccgtacacgtcctcgaggaagctcgtcaggtgccggttgacctcctccggcgcctcttcgtggctgaaatgccctgcgcccgcgacggttacgtagcggccctgcggcgcgtaacaccgggtccggtcgaccgggtcggccagcacgtaggggtcttcctcgccgcgcaggtgcagcagcggcacgccgagctgccggcgcatcgaccggaggaaccgccgtccctcgtcgcgcagctggctgcgcaccgcccagcgctggtactccagcgcgcagtgcgctgccgccgggatctgaatggccgtgcgcagatggccgatggtctcggaaaagtcttcggatgcaagccatttcgcgcagcggcggctgcggaccaggcgctcgatctccgccccgccgtcgcgggtcaacagccgctcgggccacagcggcacctggtactgcagcagtgtcggcagcagcgcccgggcctggtcgcgacgcgtcaacgtggactgccgcaacgccgccgggtgcggtgagctgatcagcgcgacggccgacaccagccgcgcgtgcagcagcgcggtggcccagcaggccaggccgccgtcggcgtggccgaccagcgtcgccgaggagtgcccgagcgcgcggatcagcccggccgcgtcgccggacagggtccagccgtcatagccgcggggcggcttgtcgctgccgccgtagccgcgcaggtcgaccgcgaccacccgggcgccggtcagcccgcgcagctgatgacgccaggaccaccagaacgatccgaagccgtgcagcagcatcaccaacggccgcgccgtggcgggcaggccgcgggcgtcaccgacgggcagggcctcgacgacgtgaaagcggatgccgttggcgtgcacatccagatggcgccacggcccgtcgatgcgggttaccgacggatccggcggcgccatctaccaacccgacgggtccgcggcggcgccgtcgccgggcttggcgtgcttgccgtggctttcggtgagcgcccgggcgccgccggccttgtcgtgcccgggcgtgagcgcggtgcgggtctccttgaccgactcgatggtctggcgcggcccccggatccggcgcaccttgaggaagcccagcaaagccagcaccgccccgaccacgacctggaccccgaacacgatcaggaacgccacccagcgccacagccaggtgtcgagcagctcggcgacgaagaagaagaaaaagaaggtggagtagaacagcaccaccagcgcggcgatgaagaagacgctgccggtgagccccttcttgacgtcccgggtgatttcggcgcgagccagttcgacctcggcgcgcaccagggtggaaacctgggtggtcgcgtccttgatcaggtcaccgatcgtcggctcggcaggcttggcatgcgggtcggtcaacgggatcgtggtcagggtgctgggcaccccgttcttgccctcgactttgctcacagacggtcctctttcgtcgttgcccggctcgctgtcgtcgcggtttatgttgccacgtggcggccggacagaagaagccagacgattccggccgatctcctggcaccgggctcggtgccacgaacaagacgtccgggccgattacactcggccaagccggtcgcgggatccggccgaccgataggagtgggttgtgcggagggcacaccgatgctgcctggtggcgatggttgccctgctcgtggcggtgacgggttcgcatccccgcgccgccgcggcggacgtcaggatcccgctgggcggtggggccggcatcgtggtcaacggcgacaccatgtgcacgctgaccaccatcggcggcgacgccgccggcgacctgatcggcttcacctcggcgcactgcggcggcccgggcgcgcaggtggccgccgagggcgcggagaacgcgggcatcctgggcaccatggtcgccggtaacgacaacctcgactacgcggtgatcaagttcgatccggccaaggtgaccccggtggccaacttcaacgggtttttgatcagcggcatcggtcccgacccggccttcggcgagatcgcctgcaaacagggccgcaccaccggcaattcgtgcggcgtcacctggggcatgggtcagaccccgggcaccatcgtgatgcaggtgtgcggccagccgggtgactcgggcgcgccggtcaccgtcaacaatcagctggtcgggatgatccacggggcgttcagcgacaacctgccgacgtgcgtcatcaagtacatcccgctgcacaccccggcggtggtgatgtcgttcaacgcgatcctggccgacatcaacgccaagcaccggccgggcgccgggttcgccccgctgccgggctgaggaattggccgaacgtcacgccagagtgacgccggccgtcgagcgtcacgccagagtgacgcccggcgaggggctggggcgcgcgcgccgactacttcgccgcccggatcgcgtcgaacaccccggggtcgagcagcgttgaggtgtcgcccaattcgcggttctcggcgatgtcgcgcagcagccggcgcatgatcttgccgctgcgggtcttcggcagctcgggcaccacgtgcacctcccgcggcttggcgatcggcgagatctcccgggccacctcggcgcgcagctcgtcgacgatcccgtcgtgcacctggtaatcggcgcacagcacgacgaacgcgcagatggcctggccggtcgtggcgtcggtggcgccgaccaccgccgcctcggcgacgccgtggtgtccgaccagcgccgactccacctcggcggtggacagccgatgccccgacacgttcatcacgtcgtcgatgcggccgaccacccagatggcgccgtcgcggtcgtaataggcgctgtccccggcgaaataccagccctgctcggcgaaccgcgaccagtaggtctcgacgtagcggtcggggtcgccccagatgccgcgcagcatcgacggccacggttggtccagcaccaggtagccggtgacgtgctcgccgtggtggatgcccggcaccagctggtcgccgtggtcgtcgacgatcctggctgagatgcccggcagcggccgcatcgccgaacccggtttggccgcagcgactccgggcagcggggagatcatcgtggcgccggtctcggtctgccaccaggtgtcgacgatcggcagccggtcggcgccgatcacgctgcgataccagcgccacgcctcgggattgatcggttcgccgaccgaacccagcagccgcaggctggacaggtcgtgcgcgtcggggatttcccggccccacttcatgaacgtgcggatcagcgtgggcgcggtgtaatagattgtcacgccgtacttttcgatgatctcgaaatgccggtgctgggtcggtgtgtccggggttccctcgtagagcacctcggtgaccccgttggccagcgggccgtagacgccgtaggtgtgtccggtgacccagccgatgtcggcggtgcaccagaacacgtcggtgtcggccttgatgtcgaagacgtaatagtgcgtgtaggcggcctgggtcaaatagctgccgctggtgtgcacgatgcccttgggcttgccggtggtgcccgaggtgtacagcagaaacagcggctgctcggcggggaacggctcgggggtgtgttcgggcgcggcggcgtcgacgacgtcgtgccaccacaggtcgcggccgccggtccaggacacgtcaattccggtgcgccgcaccaccacaacgtgctcgaccgggctgtcggggtcggcgaccgcctcgtcggcggcgtccttgagcggcgcgggcttgccgcggcggaactgcccgtcgctggtgatcagcagcttggctgccgcgtcggcgatgcgggcctgcagcgccttggcggtgaagccggcgaacaccacgctgtgcatgacgcccagccgcgcgcaggccagcatcgcgatcaccgcctcggggatcagcggcagatagatggcgacgcggtcgccggcgaccagaccgagatcggtcagcgcgttggcggccttgcacacctgcgtgtacagctcggaataggtcagactgcgctgatcgccgggagattcgccctcccagtggatggcgacccggtcgccgtggccggcctgcacgtggcggtccacgcagttgtaggcgacgttgagcgtgccgtcggcgaaccactcggcgaacggcgcccgggaccagtccagcacctcggtgaacggtgtggcccaggacaaccggttggcctgctcggcccagaacgtcagccggtcccgctcggcctcgcggtacaactgctcatccgcattggcctgctcgacgaactgcggcggcggcggatacgacgcggggcttgcggtgttgctggcggtcacgggcttcactcctgggtcgaggcgtcaaccgtcagagagcctagcctcacatggtgaaaagcaaagccttcgaatcgacgtcgaagggcgccggcgtgccggataatcaccgctgtgccgggtcactcgcggggccttcgccgatcagtcgccagctttgccgcgctggcaacgagttacgccgccgccaccgcggcggggtggcccgccgcggccctgccggccgacaccacggacacgccgacgccgtgctggtcggatcagatcgcggtgacggccgcaccggcgcagggcgcggtcggccaccgcgcggtgacgctggtgttcaccctcgccggcggcgccgaaccgtgcacgctgaccggatacgccgcggtggactcgggcgccggcggcgcgctcgtccacgcgcagcccaccccgcgcggatacctgggcgggctgccggcgggcgtcgatgcgccgcccaccgtcatcctgtcgatctccacgcagggccaggcgatcgtcgagggcgtcgccgtcgacgccgacgggcagccgtgccccacctacaccgatctgctcgtcaacccgcccgacaccaccgcggtggtgacggtgccggccaccatcgaggcctgcgagctgcaggtgcatccgatcaccgcggtctgaacgacgtccgtcgcctctggtcgggcagtagacccgcgcgggcacttcaccgccgcgccgcttcacgccctagggtcgggtgtcatgcgtgggatgcggaccccggtggccgtgctggccacggccgccgccgcgctgctcgtggtcgcctcgctggccggttgcggcggcggggtgctgagcccggacctggtggtggtcaacggcggcgaaccaccgaacccactcgttcccaccggcaccaacgacagccagggcggccgcatcctggatcgactcttcgccgggctgatgtcctacgacgccgccggcaaccccgcacccgaggtggcccagtcgatcgagagcggcgacaacgtcaactatcgcatcgtcttgaaacccggctggaggttcaccgacggctcgccggtgacggcccattccttcgtcgacgcctggaactacggggcgctgagcaccaatgcccaactgcagcaaagctttttcagcccgatcgacgggtacgacgcgctggccgccgggcagccgcagcagaccaccatgaccgggctgcgggtggtcaacgacctggagttcaccgtccggctcaaggccccgaccgtggacttcaaactgcggcttggccacagcgcgttttatcccctgccgcaggccgcctttcgcgacatggccgcattcgggcggcacccgatcggcaacggcccgtaccagctcgccggcggccccgacggcccggcgtgggagcacaacgtgcgaatcgacctgcggcccaaccccgattaccacggcaaccgcaagccccgcaacaaggggctgaggttcgagttctacgccaacctggacaccgcctacgccgatctgctctccggcaacctcgatgtgctcgacaccatcccgcccagcgccctgccggtctaccggcgcgacctgggggacagggtcaccgccgggccggccgcgatcaaccagagcctcgacaccccgctgcggctgccgcacttcggcggcgaggagggccggctgcgccgcctggcgctgtcggcggccatcaaccgggcgcagatctgtcggcagatctttgccgacacccgcagtccggcacgcgatttcaccgcccggtcgctgcccggcttcgacccgaacatcgccggaagcgacgcattggacttcgaccccgaccgggcccgccggctctgggcgcaggccgacgcgatctcggcgtggagcggcagctatccgatcgcctacaacgccgatgcgggacaccaggattgggtggacgccgtcgccaacggcatcaagaacgtgctgggcatcgatgcgctcggcgcgccgcagcccaccttcgcgggttttcgaacccagatcaccaaccgcagcatcggctccgcgttccgctccggctggcagggcgactacccgtccatgatcgaatttttggccccgctgttcgccaccggcgccgggtccaacgacgtcggctattccagcccgcggttcgacgccgcgctggcaaccgcggaggccgcgcccgacctgccgcaggcagcagcgctggccaacgacgcgcagcgaattctcttccacgacatgcccgttgttccgctgtggaactacatcagtgtggtcggatggtcggcggaagtcagccacgtgacggtcacctggaacgggctgcccgactacgagaacatcgtcaaggcttgacatgggttggtacatcgcacgccggatcgccgtcatggtgcccgtatttctgggggccaccctgctgatctacgccatggttttcctgctgcccggcgacccggtggccgcgatcgccggtgaccgcccgttgacgcccgcggtggccgcggcgctgcgggcccgctaccacctcgacgatccgttcctggtgcagtacctgcgctacctcggcggggtgctgcgcggcgacctgggccgggcctattccgggctgcccgtcagtgatgttctggcacatgcctttccggtcaccctgcggctgtcgttgatcgcgctggccgtcgaggcggtgctgggcatcgggttcggggtcatcgcggggctgcgccagggcggcctgttcgattccgcggtgctgatcaccggcctggtcatcatcgcggtccccatcttcgtgctggggttcttggcgcagttcgtgttcggggtacggttgggcatcgcgccggtgacggtgggcaacgccgccaccttcacgcggctgctgttgcccggaatcgtgctgggctcggtgtctttcgcctacgtggtgcggttgacccggtcggcggtggcggccaatgcgcacgccgactacgtgcgcaccgccaccgccaagggattgtcacagccccgggtggtgacggtgcacatcctgcgcaattcgctgatcccggtggtgacgttcctgggggcggacctgggcgcgctgatgggcggggccatcgtcaccgaaggcatcttcaacatccacggcgtgggtggggtgctctaccaggccgtcacccggcaggaggcccccaccgtggtgtccatcgtgacggtgctggtgctgatctacctggtcaccaacctggtggtggacctgttgtacgccgtgctggacccccggatccgttatggctgaacggatcagggcgcggggcggattctggcgcgagacgtggcgccggctgcggcgacgcccgaagttcatcggcgcgggcctgctgatcctggtgatccttgccgtggcgctgttccccgcgctgttcaccgccgccgatcccacctacgccgatcccgcccagagcatgttgccgccgtcgcgcacgcactggttcggcaccgatctgcagggccacgacgtgtacgcccgcaccgtgtacggggcgcgcgcctcggtcaccgtcgggttgggcgccgcggcgatcgtcttcgtggtcggcggcgcactgggcgcgctggccggcttctacggcggctggatcgacgcggtggtctcccgggtcaccgacgtgttcttcgggctgccgctgctgctggtcgcgatcgtcctgatgcaggtgctgcaccaccgcacggtgtggacggtgatcgcgatcctggcgttgttcggctggccccaggtggcccggatcgcgcgtggggcggtcctggcggtgcgcgccagcgactacgtgcttgcggctaaagcgttgggcatgagcaggtttcagatcctgatccggcacgcgctgccgaacgcgctggggccggtgatcgcggtggccaccatcgcgctgggtcttttcatcgtcaccgaggcaacgttgtcctacctcggcgtggggctgccgccgtcggtggtgtcgtggggcggcgacatcaacctcgcccagacgcggctgcgggccggttcgccgatcctgttctatccggccggcgcgctggcggcgaccgtgctggccttcatgatgatgggcgacgcgctgcgcgacgccctcgacccggcgtcgcgggcgtggcgcgcatgaccaccccgctgctgtcggtcgagggcctgcatgtcgggttcggcgagcacgccgcggtgcgcggcctggatttgcgggtactgcccggccagaccgtcgcggtggtgggcgagtccgggtcggggaaatccagcaccgccgccgcgatcctgggactgttgccgcccggcggtcgaatcacggccgggcgcatcatgttcgatggtgtggacatctcggccgccgaccgccgcgcactgcgatcgatgcgcggccggcagatcggctacatcccgcaggacccgatgaccaacctgaacccggtctggaaggtcggcttccagatccgggaagcgttgcgggccaacacctccgaccgcgacacccggcgtcgcgcggtgcagctgctggaagcggcgggaatgccggacccggcgaaacaagcggcccgctacccgcaccagctgtccggcggcatgtgccaacgcgcgctgatcgccatcgggctggccgggcggccgcggctgctgatcgccgacgagccgacctccgcgctggacgtcacggtgcagcgccaggtgctcgaccacctgcagcggctcaccgccgacctcggcacggccgtgctgctgatcacccacgacctggcgctggcggcagagcgcgccgagtcggtggtcgtcgtgcacgacggtgtcgcggtggaatccggtgcggcgcagtcgatactgcaggatccgcggcacgagtacacccgccggctggtggccgccgcaccggcgctgacggtccgcggcggcgcgcggaccggcccgcggcagccggaccgcacgcaaccggagcccgccgacatcctcgtcgcctccgacttgaccaagctgtaccgggagccgcgcgcaacattgtggcggcgcaccgaatttcgtgccgtcgacgcggtgtcgttccggctgcgccgggcccgcacgctggcgattgccggagagtcggggtcggggaagtccaccctggcgttgatggtgctcggcctgttgccgcccacctcgggcaccgtggttttcgacggcacccgcatcgacgacacgttgtcgggcgaccaacacctggccttccgccgccgggtgcagccggtgttccaaaacccttacagcagtttggatcccatgtactcggtgtttcgcgccatcgaggaaccgttgcggatccaccgcgtcggtgaccgcaggcagcgcgccaaggcggtgcacgacctcgtcgaccaggtggcgctgccgtcgtcggtgctggaccggctgccccgcgaattgtcgggcgggcagcggcaacgggtggcgatcgcccgcgcgctggcgttgcggccgcaggtgctggtctgcgacgaggcggtgtccgcgctcgacgtgctggtgcaggcgcagatcctggagctgttggccaggctgcaggccgatctggggctggcgtatctgttcatcagtcatgacctggcggtgatccgccagatcgccgacgacgtcctggtgatgcgcgccgggcgggtggtggagcaggcgcccaccgaaaagctgttcaccgccccggcccaggactacacccggcagctgctggatgccatcccgcgaccgcggcgcggcggagataggttgtcaagctgtgacggctgatccactggcgcccctgatggagctgcccggcgtcgccgaggcgagcgaccgcgcccgcgacgcgctgggccgcgcgcaccggcatcgggccaacctgcgcggctggccggtgaccgccgccgaggcggccctgcgggctgcccgcgcgtcgtcggtgctggacggtgggccggttcggctggaggatctcgccgaggccgggcagatcagcgatccggtgttcgccggggcgcttcgggtggcccaggcgctcgagggcggggaaggtccggtggtcggcatctggcggcgggcgccgctgcaggcgctggcccggctgcacatgctggccgcggccgaccaggtcgatgacgaacggctgggtcgcccgcgggccgatgccggcgtggggccacggttggagttgttggcggacttggtgaatggccgcacccgggtgccggcgccggtgcttgccgccgtcgcgcacggcgagctgctgacgctgcggccgttcggcagctgcgacggcgtggtggcccgcgcggtgtcgaggttggtcaccatcgccagcgggttggacccgcacgggttgggggtgcccgaggtcagttggatgcgtcaacccgcggcgtaccgggatgccgcgcgcggcttcgccgacggcacgcccgagggggtcggtgcctggctggtgctgtgctgccgggcgatgcgcgccggcgcgcaagaggcgttgtcgatcgccgactcgatgtcgaatcgatagctgccggggtagctgacgggccgttggatcggcgtcggaatcgggcccgataaatgtagagcgggcgacgttccgaatgttcggtccgccgcccgctagcacgggactcggttaccaagcgtgcatctcggggctgcgtgggttggcctcggcgatctcacgacgcttccggttgcagccccacccaaagggccgtagacaccttccgcaattcgcaattacgcaggcccgcaacacttctgccattttcgcggctatgactccgcgtgggtgccgagcaccgtgctgggcgcccggatcgggagatcgaaccttctcttccggatcgaccttggcctcaccgggcttccgtggttcctttgtactactagaccctgcgcacagcaaggcccaaatgtccccaatgccgcgaaacgaaatgacccgtgcggccagtgcgtttgctgtgcgggcgcggccggtcggctagaacgagtagcggcgcagcagcgagtaggtgaccgcgccggcggccagcgcgctgatgcccaccgcggcggtggtggcgatggcggcgccggacggcgcggggatacggtcccgcaacgacaccggccgggagaacgacatcaccggccagccgcgttccagcgcttcgcggcgcagcccgcggtcgggattgaccacgctggggtggccgaccgcctcgagcatcggcaggtcggtgatcgagtcggagtaggcgtagcagtgctccagcgggtacccctcgcgggcggccagctcgcggatcgcctggaccttgccctcgccgtagcagtagaaggcgatctcgccggtgtaccgcccgtcctcgacgaccatgcgggtggccatcgcgtgggtggcgcccagcgcccgcgcgatcggcgcgacgatctcctccccggaggccgacaccaccacgacgtcgcgcccgcacagcttgtgcgcggcgatcaggtcggcggcctcggcgaacaccagcggggtgacgatgtcgtgcagcgtctcgttgacgatcgacttgacctgttcgacgtcccagccggtgcacatgttggtcatgtgcgcccgcatccgatccatctggtcatgatcggcaccggaaagcagatagatgaactgcgcgtagctggacttgagcaccgcgcgccggttgagcaggccctgagcgaaaaacggtttgctgaacgccagcgtgctggacttggcgatgatcgtcttgtccaggtcgaagaaggccgccgtgcgggcgtgcgggacgccactcggcgctgactgctcgggggctgactgctccgcggccgggtcgaagacggtcaccgccccagcataggtcgacggtcccgcccggccgcgatcccgcaccggaaatggccgctcagggccgtgccgggggccgatgaggcagtgttttcgcggcgcaacgtgttttttcggaaaatgatctattgcgttactgccgactgtcatgtgtatagtaagcattactcggcctgagccgagggtgtatcagcccgaccccccggggctgatgcacgacgaccctcgcctcctccccccctggcgggggtcgtcccttttctcgggtctttccgggctgtttcccccgggtttcgggcgctccgaccggtgctgggcgcgttgcggagaatcggcccgccgtcgctggcggtgcgcgcccgcgccgggtttgtgcacagtggcgtctctatccccaaatccgcatctggcactggtgtgccaacgtcacggccccgcacagtggacggatgactggcggctccggtgcgcagtgccccgattacccggcgggttcggcgggtgtgttggcgatgctggccgaacccgagctgcgcgccgagctggatcgggtggcggccgccgccggggtgcgggtggtgcacgccggtgacgcggccgcggtgagtcgtaagacctgggcggcggccgcggccgtcgtgctggacgctgcggcggcggcgcgctgcgggcgctgggcgctgccccgccgcgatcacgtcacggtgctgacggcggccgaacccgcgacgacgacgtgggcggcggccgtgcgcatcggcgccgcgcgggtgctgcggctgcccgaacacgaagccgacctggtcggtgagctcgccgaagcggccgaatcgtcgcgcgacgacgggcagcgcgggcacgcggtcgccgtcgtcggaggctgcggcggcgccggggcctccctgctcgcggtcgccctggcccaggccgccggcgacgcgctgctggtggacctcgacccgtggggcggcgggatcgagctgttgctcggcggcgagaacaccccggggctgcgctggccggacctggcgctgcagggcggccggctcaattgggcggcggtgcgcgatgcgttgccgcggcaccgcggcgtcagcgtgctgtcgggaacccggcgcggtcacgaggtggacgccgggccggtgcacgccgtcgtcgacgccggccgccgcggggcggtcagcgtgatctgcgacctgccccgccgattcaccgacgccgcgcaggccgccttgggcgccgccgatttggtggtggtggtggtgagccgctgcgacgtgcgcgcgtgcgcggcgaccggggcgctggccccggtcctggccgcggtcaaccccaacgtgggcctggtggtgcgcgggccatctccgggcggactgcgggccgccgagatcgccggtatcaccgggctgccgctgctggcggcgatcaaggcgcagccgcaactcggcgcgcaggtggagcgcggcggcctgcggttggggcggcggtccgcgctcgcggtggcggcccgccaggtgctgggcgtgctgccgccggccggtgcgcggcgaaagggcaaggcggcgtgagcagttcgctgatcgaccgggtccgcgagcggctggccggcgaaaccgtgccgctgggcgccccgctgcccgcgtcggtggtggccgccgcgatccgggccgagtccggcgggatgctcggtgacaccgaggtgctggccaacctgcgcaccctgcagaccgagctcaccggcgccggcatcctggaaccgctgctgtgcgcggacggcaccaccgacgtgttggtgaccgcgccggacgcggtctgggtggacgacggtaacggcttgcggcgcagcgagattcgctttcccgacgaggccgcggtgcgccggttggcgcagcggctggcgctggcggccggccggcgtctggacgacgcgcaaccgtgggtggacggcgagctgaccggcatcggcgccggcgggttcgcggtgcggctgcacgcggtgctgccgccggtggcggccgccggcacctgcctgtcgctgcgggtgctgcggccggccagccaggacctggcggcgctgagcgccgcgggcgcgatcgagccggccgccgcggcgctggtcgccgacatcatcgccgcgcggttggcgtttttggtgagcgggggaaccggcgccggcaagacaacgctgctggccgccatgctgggcgcggtaccgccggacgaacggatcgtctgcgtcgaggacgccgccgaattggcgccgccgcacccgcatctggtgaagctggtcgcacggtgcgccaacgtcgaaggcgtcggcgaggtcccggtgcgccagctggtccgccaggcgttacggatgcggcccgaccgcatcgtggtcggcgaggtccgcggcgccgaggtggtggacctgctggccgcgctgaacaccgggcacgacggcggcgcgggcaccgtgcacgccaacaaccccggcgaggtgccggcccggctggaggccctcggtgcgctcggcgggctcgaccgtgccgcgctgcacagccaactcgccgccgccgtgcaggtgctgctgcacgtcgagcgcaaccgtgccggccggcggcgactcagcgaaatcgccgtgctgcaacgggttcaggaacgggtgcgctccgtcacggtgtggcacgccgaccgggggatgaccgaggccgccccgctgctgcggcgggtgctggaaaaccggatgccgtcatgaccgggccggtggcgggtgcgttgctgctggcggttgccctcgtcgtcgggccgccctcgccgcggcgccggctgggcgtggcggtgtcgggcagccggcggccatcggcgcgccggctcgcggggctgggctgggtggccgccggcgccggctgcgcggccctggccgtgctgcccctgccgagcgtgctggccggcgcggtggtggccgcgacggcgggtctgcggcatcgccgccacggccggatccgccgcgccgccggcgagggccgggcactggaaacggcgctcgacgtgctcgtcggcgagctacgggccggctcgcatccggtgcgcgcgttcgacgtcgccgccggcgaaaccgccggcccggtcgcggtggcgctgcgctcggtggcggcccgggcccggctgggcgccgacgtcgcggccggcctggccgccgcgtcgcgcagctcggcgcggcccgagcactggcagcggctcgcgctgtgctggcggctggccggcgaccacgggttgggcatagccaccctgatgcgcgccgcgcagcgggatatcgctgagcggcaacggttctcggcccgggtgtcatcgagcctggccggcgcgcgggccaccgcggcgatcctggccgccctgccggtgcttggcgtgctgctcggccaactgatcggcgcccggccgctggatttcctgctgggcgggcaggtgggtgggtggctgctgctcgtcggcgcgacgctggcctgcgccgggctgctgtgggccgaccgcatcgtcgatcgggtgatggcatgacgcgcagatggatctagcggcggtgttgctggccgcggccgtgctgatgggccccggcccctcgctgacgcgccggcgtgccggcacgccggcgcgggccggggggccaaggcgtgagccgggcccggggcgggggcgcggccccgatccgctggcgatcgcctcctgtctcgacgtgctggcggtatgcctgggcgcggggatggcggtgtcagccgccgcggcggccgcggtcccgtccgccccggcgcagttggggcgggtgctgcgccgcgccgccgacctgctggcgctcggcgccgatcccgccgtcgcatggtcgatgccgccggacccgccgggcggcccggccgacccgcagatcgacgcgctgctgcggttggcccggcgttcggcggcctcgggcgcggcgctggccggcggcgtcgccgagttggccgaccagtcccgcagcgacgccgcccatacggccgccgccgcggccgagcgggccggggtgctgatcgccgggccgctgggtctgtgcttcctgccggcgttcgtctgcctgggcatcgtcccggtggtggccgggctggccggcgacgtgctgcggtccgggctgttgtgaaaggaaaggaagtcattgatgcgcaaggtgtttcgcgaattctcggctcgtgtggcggtgctggtggccgacgagtcgggcatgtcgaccgtcgagtacgccatcggcaccatcgcggcggccgccttcggggcggtgctctacaccgtggtcaccggcgattccatcgtgtccgcgctgaccaacatcatcggtcgcgcgctcaacaccaaggtatagccggctgtgccggcgccagcaccgtcgaggcggcgctgggcatcgcctcgctcgtcgtggtgctggtggcctgcctggccggggtcaccgcggttgcgatgcaggtgcgctgtgtcgacgccgcccgcgaggccgcccggctggctgcccgcggcgacgaacgctccgccacggcggccgcggtccggctcgggcccgcgggggcgcgggtcgacctgcgccgcgacggcgacctgctggtggccaccgtggttgcgcattcgaaactgttgcccgccctcgatattcgggcccaggcggtctcggcggccgagccggcacggtgagcgcgggtcggccaccctggtcgcggcctggatggtggtggtgctgctgtcggcgaccggtgccgcggtctacctcggtgccgcggtggtggcgcggcaccgggccccggcggcggccgatctggcggccctggccgccgcggcccggttgccgtcgggagccgatgcggcctgcgcccgggccgcggccgtggcccactccatgcgggtcgacgacatcggttgtgtcgcagacggtctcgacgtcgtcgtcacggcgcgggtggcggtcggcgccgtcggcaccgccgtcgccgccgcgcgggcgggcccggcgaccggctaaggcgttccgccggtggcttgcggcaggcccgcagcggccagctcttcctcggtgggcaaccgcagcgagaccagcccggcgtaggcgtccggctcgagttccacccggttcaccgtgatgtgcaccggcacccaatcgccgtcgtgcccggccagccgcagcaccctgctggtggcgcccccgctgaattcctctgtcatggccgacatcacggcgtggtcgtcggggtggacccggggcttgccggtctcgctgctgcgccagtcgtaaaaggtgcacggctcgtccagccatttcaacagcgtccaattgttgagatcgatcagcgcgcggtgcaccccggcctgggccagcccggacaggatccgctgcgccagatcgtcggtcgacaccgcgggccccttctgctcggcctgccagttgatcgcccgcgccaccaggtgttcccggctgtcgggccccggctccaagatggtgcgcgccacgaaaccgatccgaatggcctcgccccgccagtcggtgagatcccaagtgctgcacagtgtttgatcgggtttggccttgaccgccatggccagcaccttggtttcgttcgggttgagctcacgcgacgggagatcctcggcgaacgcccggccgaacgtgacctcgacctcggggttcttgccgctgttgatcagcgattcgcgggtgtcggtggccacccccagcgtcaggtcccatttcagcggcccgggaatcggccgctccggcggctcgatgtccgacggcccggtccacacgtgcacgccgtggatgaatccgtcggacatcaccaccggttcggtgcggatgacgcggtcgcgcttgggggtgatgctggtcaacgcctggccggtctgcaccgactcggcgatcgccgtccgaaccgcggagagataggggctgcggcgcaggaacgtggtgatcggcacgagattcttgagctgacggccctgcgccacaacggtgggatcacccccgagcgtctccacgagcaaccagtcgtgggccatgcggccgattttacggtggcccggcgggtccggggcaggcgcgggtgaaccggcccgcggatttcgccgcccgccggtgcgccgaggcgcgactgaacctggcccgcggatttcgccgcccgcccctgcgctcagcgcggccctcggtccaactccgcgaggaccaatcgcaacacccgcgccgcgcccgccttgtcgagcgggtcgttgccgttgccgcacttgggcgactgcacgcacgacgggcagccccgggggcactcgcacgcctcgatggcggcggccgtcgcccccagccaggtgctggcccggcgaaagccccgctcggcgaatccggccccgccggggtgaccgtcgtagacgaagacgctgggcaggccggcgggttcgggtcccaccgcggtggacaagccgccgatgtcgccgcggtcgcagctggccaccagcggcagcaacccgatcgccgcgtgctcggccgcgtgcaacgacccggggatgcgcgggccgtcaatgccgttgtcccgcaacgcttcctcggtgatggtgtacatcgccgcggtggtggccagcgtgtgctccggcatgtccagttcgatgaagtcgatcacctctccggacaggcggcggcgcaggtagcccaccacccggtgggtgacccgcaccggcaccaggcccagggtgaccggcccgaagaccagccgctccccggcgccggtgacggcgatgtcggtgatttcccgcgcgaacgtcgcatacccgggatcctcggcgtgcacgaacgcgatgccctcctgtagatccagcgagtcgacgacgtagctctcgccctgatgcaggtagaccgcgcccggatggaccgacgccggcgcctgcccggcgccggcgctgcccagcaaccggcccgtgtcggcctcgaggatgacgacctggccgcccgctccccggatgtccaccgcggcgtgcggctgcaggccgggcgccgggaagtacttcccgttccgccgccgcagcagcccgtcgtcgaccaggctctcggccacctcggtggcgtccagctcgcgcacctccgcctcctgcagcggcaattccgttgccgcacacagcaattgcggacccagaatgtaggggttgcgcgggtcgatcaccacccgctcgaccggcttgcccagcagcgcggccgggttgtgcaccaggtaggtgtccagcggatcgtcccgggcgatcagcaccaccagcgccccctggccgcgccgcccggaccgcccggcctgctgccagaacgaggcgaccgtgcccgggaaaccggccagcaccaccgcgtccagcccggcgatgtcgacccccaactccagcgcgttggtggtggccaggccccgcagccggccctcggccagcgccctctcgagggcggtgcggtcctcggcgagatagccggcgcgataggacgccacctgcgccgacaaccccggggcgatctcgtccaaccgggcctgcgcgccgagcgcggtcaactcggccgcccggcgcgaccggacgaatgtcagcgtctgcgcaccctcggcgatcaggtcggccatcacccgcgccgcctccgcaccggcggaacggcgcaccggcgcaccgttctcgcccaccagatcggcccgcagcgccggctcccacaacgccaccgtccgcgccccctgcggggaaccgtcttcggtgacctcccgcaccggcagcccgatcaactcggcggccgtcgcgccgggcgaatccgttgtcgcgctggcgaagatcaccgtcggcgcgctggcgtaccgggcgcacaaccgcaacagccggcgtagcaccatcgccacatgggagccgaaaaccccacggtagtaatgacattcgtcgacgatcacgaagcgcaggccgcgcaacagcaccgcccagcgggcgtggttgcgcagcgtcgacagatggatcatgtccgggttggagaacacccagcgggaccgctcccgcgcgaagcggcgcacctcggtggggctgtcgccgtcgtaggcggtgggggcgaccgcgaaaccgggttcccgcagccgcggaatcgccgcggtcaacgcgtgcgcggcgcgtaactggtcgtggccgagcgccttggtcggcgacaggtagagcacccgggcccgcgggtcggtggccaacgcgttgagcgcgggaagctgataggccagcgacttgcccgacgcggtgccggtgctgaccaccacgtgacggcccgaccaggccaggtcggcggccgtgaactgatgcgaccagggtgatttgatcccgcgcgcggcgaacgcgccgaccacctccggctcggcccacgccggccagtcgtgcggccggccgcggcgcggcggcaactcggccacatgacgcagcggctgctcgtcggcggcggtcccggcgagcgcggcggccagcagctcactgccgaaactcgccatctcgcccctcgttgaaccgcccggcgacgcaagtctgtcgccgacgcgatgaacatggttgactatttgcggtcgcagcttctgtgttcgtgtcaaactttcgcaggatcgacgttgcggccgcggttcctgcgaggttaatcggtcgggtgaagttccggcgactgagcgaggtatggcggtcgtaccaggacccggggcatcgaaaggcgatgccccgcacccagaagaaaaggaaagatcgagagatgccacagggaactgtgaagtggttcaacgcggagaagggcttcgggttcatcgctcccgaagacggttccgctgacgtgtttgtccactacacggagatccagggaacgggcttccgcacccttgaagagaaccagaaggtcgagttcgaaatcggccacagccctaagggcccccaggccaccggagtccgctccctgtaggcgagcagacctgaaacggataccccccgtgcagtcccgcccagcgggcccggccggggggtttcctcttttctctggttttctccaggggtttcatccctggtgatctcccgcggcccgagtcggcgcgcccgcaacgccgattgcctcaagacgcgaacggtagacctggcctactgtcggatggcgtgagccagctttccttcttcacggcggagtcggtgccccccgcggtcgccgatctctccggggtgctggcggcgtccgggcagatcgtcatggtcgggaccccggaaccccacggcgcccggctgtcggtggtggtcgaccacacctggcgcgccgaggcgctggcggacatgatctccgaggccggcctggtggccgagatcggccggaccgacgaggacaccccgctggtgcgcaccgcggtggaccccgcgctgagcccgctggccgccgaatggacgcgcggcgccgtgaagaccgtcccgccgcgctggctgcccgggccgcgcgagctgcgggcctggacgctggccgccggcaaccccgagggcgagcactatgtgctggcgctggatccgcacgcacccgacactcactcgccgctggcgtcggcgttgatgcgggtcggcatcgcgcccacgctgatcggcacccgcggcgggcggccagcgctgcggatcagcggccgccgccggctgtcacgcctggtagagaacgtgggagagccgcccgacagcccggaggcgtcggcgcactggccgcgcgtgtagcgggcggacggaccccggatccggcccgccgccgggcccgccggtttgcgcaggcgagcctccgggtgcgaaattgtcaggtgccgcagggcgaaggaacggtcgcgtactgtgaatttcaccggaattttcgtagccgacctgtcattcttcctgcaggtggtctcgcaggggggaccaatcagggatggagcgtaagggcagttggctgacccgaaactgaaggaaaacaccagcggcgggaacggcagccgccggcgactcgtgatcgtcgagtcgcccaccaaggcgcgcaaactggccagctacctgggctcgcggtacatcgtcgagtcgtcgcgcgggcacatccgcgacctgccccgggccgcggccgacgtgccggcgaaatacaagtcggagccgtgggcgcggctcggcgtgaacgtcgacgccgacttcgagccgctgtacatcatcagcccggagaagaagcacaccgtcagcgagctcaagggcctgctcaaggacgtcgacgagctctacctggccacggacggcgaccgcgagggcgaggccatcgcctggcacctgctggaaaccctcaaacccaacattccggtcaagcggatggtgttccacgagatcaccgagccggccatcctggaggccgccgagaaccctcgcgacctggacatcgacctggtcgacgcgcaggagacccggcgcatcctggaccggctgtacggctacgaggtcaccccggtgctgtggaagaaggtcgcgcccaagctgtcggcgggccgggtccagtcggtggccacccggatcatcgtgcagcgcgagcgcgaccggatggcgttccgcagcgcgtcctactgggacatcgtggcccagctggacgccagcgtgtccgacccccaggcctccccgcccaccttcgcggcccggctgaccagcgtagacggcctgcgggtggcgaccgggcgggacttcgactcgcagggtcagctgcgcaaggccgacgaggtgatcgtgctcgacgagccccaggcgaccgagctggccgccgggctgcagggcgcccagctgtcggtggcctcggtggaggaaaagccctacacccgccggccgtacgcgccgttcatgacgtcgacgctgcagcaggaggccggccgcaagctgcggttctccgccgagcgcaccatgagcatcgcccagcggctctacgagaacggctacatcacctatatgcgtaccgactcgaccacgctgtcgggttcggccatcaacgccgcgcgcacccaggcgcgtcagctctacggcgaggagtacgtctcgccgtcgccgcgccagtacacccgcaaggtgaagaacgcgcaggaggcgcacgaggcgatccgtccggccggcgagacgttcgccaccccggacgcggtgcgccgcgagctcgacggcgacgagttccggctctacgagctgatctggcagcgcacggtggcctcccagatggccgacgcgcgcggcaccacgctgagcctgcggatcggcggccaggccggggaccggcaggtggtgttctccgcgagcgggcgcaccatcaccttcgcgggttttttgaaggcctacgtggagaccgtcgacgagctggccggcggcgaggccgacgacgccgagagccggctgccgcagctgacccagggccagcggctggacgccatcgagctcacccccgacggccacgccaccaacccgccgccgcgctacaccgaggcgtcgttggtcaaggcgctcgaggagctgggcatcggccgcccgtcgacctactcgtcgatcatcaagaccatccaggaccgcggctatgtgcacaagaagggcagcgccctcgtgccgtcctgggtcgcgttcgccgtcaccggtttgctggagcaacatttcggccggctggtggactacgacttcaccgccgcgatggaagacgagctggatgcgatcgcctcgggccaggagcggcgcaccgactggctgaacaacttctacttcggcggcgagcacggcgtggccgactcgatcgcccgctccggcggcctgaagaaactcgtcggcgtcaacctggagggcatcgacgcccgagaagtcaactccatcaagctctttgacgacgagcagggccgccccgtctacgtccgggtgggcaagaacgggccctacctggagcggatggtgaccggcgacgacggcgagcccaccccgcagcgggccaacctcaacgactcgctgacccccgacgagctcaccctcgaggtggccgagcagctgttcgccacgccgcaggagggccgggtgctgggggtggatccggcgaccggccacgagatcgtcgccaaggacggccgttacgggccgtatgtggccgaggtgctgcccgagccgccgcccgacgatgacgacggcagcggcgcgcccgccaagaagggcaagaagcccaccgggcccaagccgcgcaccgcgtcgctgctgcgcaccatggacctgcagacggtcaccctcgaggacgcgctgcgcctactctcgctgccccgggtggtgggggttgaccccgagaccggtgaggagatcaccgcgcagaacggccgctacggcccatacctgaagcgcggcaacgactctcgctcgctggcctccgaggagcagctgttcgacatcaccctcgaggaagcgctgaagatctacgccgagcccaaacgccgcggccggcagggcgccgccgcgccgccgctgcgggagctgggcgccgatccggcgaccggtaagccgatggtgatcaaggacggccggttcgggccgtacgtcaccgacggcgagacgaacgcgagcctgcgcaagggcgacgacgtcatgtcgctcaccgaccagcgcgccgccgagctgttggccgaccgcagggcgcgcggcccggcgaagcggaccgccaagaaaaccagccgcaaggccccggccaagaaggcggccaagcgcggttagccgctcacctcgctggaaacctcttgcggcgcaacctcttcgggggtggccagcttcaccggtcgggccaactgggtgggtgcggtgcggccgcgcagctcgacgacctcgccgacgtcccagcacaacgcctccgaatccagcgcgccgctgactgcgatcgccgacgccagcacgtggccgggctcgagtttggccagctcggtcagccgggcggcctcgttgaccgggtcgccgatcacggtgtactcaaaccgggcctgcgcgccgatgtggccggcgatggcgcggccggccgacaccccgatgccgaactccgccgaaccgatcaccggcagcagcgcgtcgtgcaactcccgcgccgcggccagcgccccgccgggggagtcggggtgctcgatcggcgcgccgaagatggccagcgcggcgtcaccctggaacttgttgacgaaaccgccatgcttgccaacggtttccaccaccacccggaagaactcgttgagcaggtgcaccacctcggcgggcgggcgggtggcggccagctgggtggagccgaccaggtccacgaacagcaccgcgacatcgcgttcctgaccgcccagctcggtgccgcgctccagggcgcggcgggccacgtcctcgccgacgtagcggccgaacaggtcgcgcagccgctgccgctcggacaggtcgcggaccatgtcgttgaagccggcctgcagcaggcccagctcgctggcgtcgtagatctgcatgtgcgcgttgtagtttccgcgctgcacctccgagagcgcccagcgcagctggcgcagcgggtcggcgatcgacatggccaccagcagcgtgctgaccagcccgatgcccagcgccgcgaccgccagcagcaggatgggggtgaacagcttctccggcgtggcatgcagcagcgaggtcttgtcggccaccaccgccagcacgatggccagcaccggcaccgcggtggacagcatccaggtcaggatctggcgcaggatgacgccgggcgccttgacgttctcgggcaccccgctgcgcagcgcggcgacggccaccgggcgcagcacccgctcgcactgcaggtagccgatgatcgcggtggccgcggcgcccagcccggtggccaccgccaccaccggcgcggcgaaccgggccaccgaccagctggcgatgatgaacaccacgccgccgatgcaccagatcaccatgctggtgacggtgcggtagaacggcatgcgcagcgcgcggatgcgggcgagttcggtggcggccgggtcggattcggccagcaggttgtcccggcgctgccaccggaacaccggcatcagcagcgtcaggttcaccaccgaggcggcgaggaacagcaccaccaacgacgtcgcgaacaccgccaggttcaccaccggcaggtcctgaagctggatgcggtcttcgggcggcagggcgtagcgcaggaagccgagcacgaacagcgcgccgatgatgtcggcctgcatcatgctcagccagaacaacggccacggtgtgcgcaccacccagcgggcgaatgcgctgatccgccccggtagtgccgccgctgttgtcacgatcccaccgtatcgggcggcggcgacgtcccggaaactaaattgcgttctcggcaggtcatttcggcggcgcgacggcggcgaagataacggaatggtcgcggtatggtggccgattggtatctgtcgggcggtcgcagtaggttaggcgctgatgtccggggtgtttacgcggctggtaggccaggacgcggtgaaggccgagctgctcggtgcggcccgggccgcccgcggtgatgcgggccacagcgacgcgggcgccgggactatgacacacgcctggctgatcacgggcccgccggggtccggacgctcggtggcggcgctgtgcttcgcggccgcgctgcaatgcaccgcggacggcgaaccgggttgtggccgctgccatgcctgcacgacgaccctggccggcacccacgccgacgtgcgccgggtggttcccgagggcctgtcgatcggcgtcgacgagatgcgcgccatcgtgcagatcgccgcgcggcgcccggccaccgggaactggcagatcgtggtgatcgaggacgccgaccggttgaccgagggggctgccaacgcgctgctgaaggtggtcgaggagccgccgccgtcgacggtgtttctgctgtgcgcgccgtcggtggaccccgaggacgtggcgattacgctgcggtcccggtgccggcacgtcgcgctggtgacgccgtcgaccgaggcgatcgcccgggtgctggtcgacagcgacggcctcacccccgagacggcggactgggcggcgtcggtcagcggcggccatgtgggccgggcgcggcggctggccaccgaccccgaggcgcggcagcgccgggagcgggcgctgggcctggtgcgcgacgcggccacgccgtcgcgggcctacgccgcggccgaagagttggtggccgcggccgaggcggaggcggtggtgctgaccgccgagcgcgccgaggccgagaccgaggagctgcgcacggcgctgggcgccggcggcaccggcaagggcaccgcgggcgccatgcgcggggcggccggggcgatcaaagaccttgagcggtgccagaagtcgcgtcagacccgggcgtcgcgggatgcgctggaccgggcgctgatcgacctggcgacctacttccgggacgcgctgatggcctcctccggcgccggggcggtgcgggccaaccacccggacatggccgagcgggtcgcggcgctggccgcgcacgcgccgcccgagcggctgctgcgctgcatcgaggcggtgctggagtgccgcgaggcgctggcggtcaacgtcaagcccaagttcgccgtcgacgccatggtcgccaccatcggccagcaacttgggtgacgcgacccctctgccgtagactcgtgccgcccatcgggcacgccaccttagctcagtcggtagagcggctcactcgtaatgagcaggtcaggagttcgattctcctaggtggctccgtttgtctgtatgacctcggttgatgcttgacgtttcggcttcgggtgatgcctgacagtgtttcggctgatgcttgacagttacttcggctgatccttgacactccttcgatgaaggagttaaccgtggccgagcagaggtatcaggccgtgttggcggtgatcagcgatgggttgtcgatttcgctggttgccgagaaggtaggcgtgtcgcgccagacgctgcacgcgtggttggcccgctatgaggcgtcgggccttgaggggctggtggatcggtcgcatcggccggtgtcgtgtccgcaccagatgccggccgtggtggaggccgccctgttggagcggcgccggtcgcggccgtactggggaccacggcggctggtgttcgagctggctaagcgtcgggtgggtccggtgccgtcggagtcggcggtgtatcgggccttggtgcgggcgggcatgatcgatccggctttgcgggatcggcgttcgcgcaagtggaaacgttgggaacgcggcgccccgatggagctgtggcagatggatgtggtggggggtttcccgctggccgatggcaccagcgccaaagcgttgaccggcatcgacgaccattcccggatgtgtgtctgcgcgcggttgatggcgcgtgagcgtacccgcgcggtttgcgacggattgcgggcggcgctggcggcttacggggccccccagcagattttgactgataacggcaaggtgttcaccggccggtttaaccatcccccggtggaggtgctcttcgacgcgatctgccggcaaaacggcatcgaccacctgctcacccagccgcgtagcccgacgacgacaggcaagattgagcggttccaccgcagtctgcgcgccgaattcctcagcaacacaagggctttctcaaatctgaagacggctcagcaagccctcgacgaatgggtgcactactacaacaccgcccgtccgcatcaatcgctgaacatgaccaccccagccgaacggttcaccgccaccgcctcgccggtgagccctggcgacgacgtacccgccagcatcgaccgagacggccaggactgggtcagccgccgggtaacgaccaacggggtggtcagtgtggcctggcagcaggtctgcgtgggagcccactacgccggggcccgctgcgatgtccacgtcgacggtgagctgctgcggttctggatcggcgaccagttagtcaagaccgctgcgcgcaccaaccatgcagaggtaagaaacaaacgggccttccgcacccgcgaacaggcctaaccactaacccagagtgtcaaggatcaaccgacatagaaatgtcacccatcaaccgactctgaacaggggctccgtttgtctggcgccgagcgtcacgccagcgtgaccgtcggcgccgagcgtcacgccagcgtgacggcggcgggcgaggtcctcacgccggggccagaaagccgaccgggcccgacgcgaggcacagcgccagcgcggtggtgttggcccgcaccgtgatcgcgtccccggcgccgggcagccggacgaagacgcggttgagccccggatgcaccggcaccttgaccggagggccctgcgtcatcgacaacgtcatcgacccgtcgctattggccaggtaattcagctcgacggtccagtcggccggcagcagcggcccgtccaggaccaggcgggccggtcggtccggctgcgcgaaatacccgcactgcggcatcggcccgggcgtgatggtgcgcacccaggtcacccgcgccctgatcagccgccccgagctgtccagcattcgcaattgcgttgtcgccgaagcgaattcgggcctgtcgcggagcagcgcgaacaggtggctggccaggttttccggcgcggccacccgttgcagcaccagcgggtcgacctcctggtccagcagcggcgcgtcgctggccgcatgcgccgccgccagcgcggcccgggcgttgcgcagatagggctgggcggggttgtcgcgccagctggtcaggaacgtggccgtcgagtacaggctgctggccaaaaacagcgccgccaaaccgcacgcgactaccgtgcgtttcggtgaggcatccaaccggcgcggcccggcgggccggttgggggcgctgagcgcgacggcggccagcagcgccagcacgacgacgagatccggcagataccgcagagtctgggcgagttccagcgcggtctgcttggacgaccgcatcagatagatcggcacctggcaggccaccgcgtagccggccgcggtcagccacaccggcccgatccgccgcttgcgcagcagcgacaccgcgagcaccccggccaggaccagccagcccagcaccatcaccagcggcggcggcgtggcccacggcgaggccggcgcccagcggtcccagtgccacggcccgccggccagccccggcactatcccgtgcgtgatcgagcgcaccagcagccggcccgtcatcaccacgtccgaactccaccgccgctggttgaccacggccaggtacagccccacccaggcggcggtcaacgccagcgacggcacccacagtcgcaggccggcccgccacaccgtgcgcgcggccgcgcgatcgcccgccacatgacgcagcagcgcggccaccgcgaacgccacgaacgggatcaccgcggccttctcgaagaacagcagcccgccgaggtagaccagcaccccggtcagcgcgtaacgccggttcccggtgcgcaccagcaggatcgcgtcgccgcacacccaggccagcgccgccagtagcggcagcgaattcagcgccgccgcccaccacgcgaacccgggcaccgccagcggggtgaacaaggcgaacgtgaacgggatgagcagcaccggccgccagcccaggatcacgtgcagcgcgcgcaacaacgccagcgacgccagcagctgcagcaccagcaggctgaccgccggccaggtccagtccagcggcgcggcccggatgatggtgccggcgagcaggaatgcccccggcatgaggtgcccgtcgtggtcgtcgaacagatacgacggcgccagcaggttgtgggtgccggccttgccgatcaggatcaggtcgtcccaatagaagtagccgccgaacgccagcaccgcgcgcaccgccagctgcaccacgacgagcgcggcggccgccagggctatgtatggtgggccggtgcgcgcactggttaccggggcagccggattcatcggctcgacgctagtcgaccgcctcctggccgacggccacacggtggtggggctggacaacttcgcgtccggccgcgcgagcaacctcgagcatctggtcggcaacccggcgcacgtgttcgtcgaggccgacatcgtgaccgccgacctggaggccatcctcgacgaacaccgcccggaggtggtgttccacctggccgcccagatcgacgtgcggcactcggtggccgacccgcaattcgacgcctcggtcaacgtcatcggcaccgtgcggctggccgaggccgcgcgccgcacgggcgtgcgcaagatggtgcacacctcctccgggggctccatctacggcaccccgccgacctatcccacccccgagaccgtgcccaccgacccggcctcgccgtatgccgcgggcaaggtggccggcgagatctacctgaacaccttccgccacctctacggcctggactgctcgcacatcgcgccggccaatgtctatgggccgcgccaggatccgcacggcgaggccggtgtggtggcgatcttcgcccaggcgctgcagtcgggcaagcccaccaaggttttcggggacggcaccaacacccgcgactacgttttcgtcgacgacgtggtggacgccttcgtcaaggcatccggggacgccggcggcggccagcgcttcaacatcggcaccggcgtcgaaacctcggaccggcaactgcattcggccgtcgcggccgccgtcgggggacccgacgacccggagttccacccgccgcggctcggcgacctgaagcggtcctgcctcgatatcggcttagccgcaagagttttgggctggcaaccgaaggtcggcctgcagcagggggtggcccgcacagtggagtacttccgcaaccagcacaactagttcgggtcgggaggcagcgcggattccagcgcgaccgcccgggccaggcgcgcgtagcgcagctccaggtccttgaaccgcatataggtgctgagcgtggtgaagcagaacgccatcaccagcgcgtagagcatcaggtcggtgccgcggcgcaccccgaaccagttcgccaccacggtggtgtcgtcgggccgcagcacggcatagataccggccagcacgaacaccacgtagccgaccttgacccaggcccgggatcgggcgttgcgccgcgagcgcagcaggtaaaccagcagcgccacaatggatccgatcagcagcacctggatccagttcatcgtggaatccttcctcgcagaaatccgtcgaaaatgatgttcaccccgttgagcagcggttggcccttcgacctcgagtactcggtgtagagcacctcgatgggttcttcgaccacgcgccaatggttttcgtcgatcagcatgacgaactcgttggcgtggctcatgccgctcatggtgatgtccagcccgtcggcgaccttcttgttgaacacccgcagcccgttgttggtgtcggtcaggccgagccggcggccgcgccggctcagccgtgccgcggtctgcagcaccatgcgcttcaccaacggcggccgggccccctgccgggtgccgaaccgggtgccgatgacgacatcgacgtcaccgacccgcagccggttgaccatcgcggccaggtctttgacccggtgctggccgtcggcgtcgaaggtggcgaagacctgggcgcccggctgccggcgggcgtactcgaccccggtctgaatggccgcgccctgcccgaggttgatcggatggcgcaccaggtgcgcgccggcccgccgggcgatttcgccggtgtcgtcggtgctgccgtcgtccacgcagacgacgttgtcgaataccgaacgcacatcggctatcacctcgccgatgacggcggcttcgttgaaggcgggaatcacgacccagacggccgaataatgcgtgtcagtacccatctaagcccacaaggtacacgccggtgcaggtcggatcagccggttaggcgcgcggcgcgcgacaacgccaccagatgcacgccgatacccaccagcggcccgcacagcagcccgaccacggtccgggtctgcagcgacaacggcagcgccagcagcaatcccgatgcgaccgtggcgcccacccaccccagcgcgtaggcccggtgcagcgcggcggccaccgcggccgcgccggtcagggtgagcatcgcgatggccaccgccgccgcggtcagccaggccagcagcgcgctgccggcctggtactgcgggccgaaaacgacccgtaacacccacgggcccagcacgcccgcggccagcactccgaccgcgccgatcgccccgacgatggccgccgggccgatcagcgcccgaacccggtcgctgcgctcgtcgacgaaatgcgcaatcaggttgccctgcatggccgtcagcggcaccagcagcggcgcgcgggtcagcgtgacggcgaggatgatcaccccgccctgcgcgccgagctcggcgctggtcagcttcagcagcaccggaaaccccatcaccaggatggcgctggcgcccgcggcggtgatcgaatgcgcggcgccgcgcaggaacgtcgcggtgccgcccggggtcagcagccgcgcggtggcgcgggtggcgggcgaggccgccagcaggatcagccacgcgaccgcgccggcgaccgtcgcccacaagaagccgaccaggcgccaacccagcaccacggtggccgcggccaccatcacccggatgacggcgtcggtcaccatcagcgcgccgtagcgggtccactcgttggtgccggccagcatgcccagcagggtggcgtggacgcagaacccggccagccccacggacagcagcagcaccgacagcggccgcgcctcgacgaacacccggccgctccacaacggcgagctgccggcgatcacgacggccgcggccgccccgagcagcatggcgacccgcaacggatgggtgcgcttgaccggtgcgacctcgaggtagggcatcacccggacttcccgggtggtctcctgcagcagcccgttggccgcgccggtgaccagcccgaaagccccccagaacaccccgaacaccgaaaagccgcccggcgccaggtcgcgggcggccaggtagatcaccgcgtatccgcacagcgccgtgacggccgtggcggtcccgacccgggccatgctgccgcgcgccaccggcccccgcgaggcactgatctcggtcatcggggcggcgctttcggcccgctgccccgaggtatcgccacaatttgaaaatagtaagcggcccacagcgtgcgccgcggcggcgatcggtgttggttagggtgggcggcggccggaaaggatcgcagtgcccgctttgcgcaccttcggggtctcgctgttggtcaccgcggcggccctggtcctcggatacgcctacggcggccccaagagtctgtacctgctgctggtgctggcggccctcgaggtgtcgctgtccttcgacaacgccgtcatcaacgccgcggtgctcaagcagatgagccggttctggcagcggatgttcctgacgatcgggatcctggtcgccgtgttcgggatgcggctgctgttcccgttgctgatcgtgtgggcgaccgcgggcctcgacccggtgcgcgcgctcgagttggcgctgcgcccgcccccgcacggcgcgctggaatttcccgacggctcgcccagctaccagaagctgctcaccgccgcccatccccagatcgccgcgttcggcggcatcttcctgctgatgctgttcttggacttcctgctaatcgatcgagatatcaagtggctcaagtggattgaggttccgttcgcccgcatcgggcggctgggtcaggtgtcggtggtgctgagcggcctgacgctggtgctggtcggcaccgggttgacgcactccagccaggaggcggtgacggtgctgaccgccggactgctgggcatggtcgcctacctggtggtcaacggtttgagccgggcgtttcggccgtccggggtggggcaaccgcaaccggccggcccggcgaccggctgggccgggctgagtctgttcctctatctggaggtgctcgacgccgccttctcgttcgacggggtcaccggcgcgttcgcgatcacctcggacccggtcgtcatcgtgctggggctgggcgcggtgggctcgatgttcgtccggtcgatcaccatctacctggtgcaccaggaaacgctggaccgctacgtgtacctggaacacggcgcgcactgggcgatcggcgcgctggcggtgatcatgctggcgtccatcgagccgcggctgaccgttcccgagccggtgaccgcgtcggtcggggtgttcttcatcggaacggcggtgggcttcagcgtgctgcggcgccgccgcgaatccgggcgggctagtgctcctgggccttgaaccgttcgatcgaccgctgcacctcggcctcggcctcggcgcggccgacccagtcggcggccttgacgaacttgcccggctccaggtccttgtagtgcacgaagaagtgcttgatcacgtcgagctcgaactccgggacgtcgccgatgtcctggatgtgctcccagcggtggtcgccggccggcacgcacagcaccttgtcgtcgccgcccttctcgtcggtcatccggaacatgccgaccggacgggcctcgacgatcaccccggggaacaccgactgcggcagcagcaccatcgcgtccagcgggtcgccgtcctcacccagggtgtcctcgatgaagccgtagtcggtcgggtaggccatcgcggtgtacaggtagcggtccaggcgcagccgaccggtctcgtggttgacctcgtatttgttccgctggcccttgaggatctcgatggtcacgtcgaattccaccgcgtcggctccttgtctgggtaggcagtctgggaaggcaggccaattttgctctgctacaccctagtcgagcccggcggcgccgattcggcagaatggcgtgcagacagtcaggagagtgatggcccgtactcgctggcagaaatccaccccagtgttcatcgggttgggcgtgctggcgttcgtcgctgccgtggtggttgcggcaacgtttttcaccacgaccgggcacggcgcgggcaacgcgcacgccccgataccggctccgcatgcgcccacggtcaagccgggcatgctgccggtcagcgacaccgccgagctacccaccggacccggggtgagcgccgcgctggcgccggtggctgccgatcccaacctgggccggctgggcggccggatcaccgacgccatcaccggcaaagagctgtggcaggtggccgacgacatgccgttggtgccggcgtccaccaacaaggtgctgaccgccgcggcggcgctgctgaccctggaccggcaggcccggatcagcacccgggtggtggccggcagccagaacgcgcaggggcccgtcgtgctggtgggtgcgggcgacccggtgctgtcggcggccccgcccgggcagccgacctggtatcggggcgcggcccggatcagcgacctggtcgagcagatccgccgcagcggggtgacgccgaccgcggtgcaggtggacacctcggcgttcagcgggccgacgatggcgcagggctgggatccctccgacgtggacaacggcgacatcgcgccgatcgagtcggtgatgatcgacgccggacgcatccagccgaccacggtcaactcccgccgcacccgcacaccggcgctggacgcgggccgggagctggccaaggcgctggggttggaccccaacgcggtgacggtcgcgacggcgccgtccggggcgcggcagctggccgtcgtgcagtcggcgccgctggtgcagcggctgtcggagatgatggaccactccgacaacgtgctggccgagtgcatcgcccgggaggtcgcggcggccatcaaccggccgcgcagcttcgcgggtgcggccgacgcggtcaccaaccggctcagcaccgcccacgtcgacaccgccggcgcgacgctgatggattccagcgggctgtcggtggacgaccggctgacggccaagacgctcgacggcgtgctgcaggccgccgccgggccggaccagccggcgctgcgggcgctgctggatttgctgccgatcgccgccggcagcggcaccctgggcgaccggttcaccgacgcctcgaccaaccagggcccggccggctggctgcgcgccaagaccggctcgctgaccgccatcaacgcgctggccggcgtgcttaccgaccgcagcgggcgggtgctgacgttcgcgttcatctccaacgatgccggccccaacggccgcaacgcgatggacgcgctggccacccggctctggttctgcgggtgctcatgacgccggcgcccgatctgacgctgggtaccgccgtcgactggcgattcgcggcgaccgtcggccggcggctggcccggcccggcccgccgtccaccgactacacccgccgccaggtgatcgacgaactcgccggcgccgccaccaaggccgagccgttggtgcgccaggtcaccggcctgctcaccgacggcgccgacgacggccgggtgcccgccgcccgcatcgtcgaccgcccggagtggatcgccgcggcggcggagtcgatgcgggtgatgatgaacggcaccgagcggccgcgcggattcctcaccggccgggtcaccggcgcgcagaccggcgcggtgctggcctacgtgtcgtcggggatcctcggccagtacgacccgttcgcgaccgaccggggggccggcgcgggttgcctgctgctggtctaccccaacgtcatcgccgtcgagcggcagctgcggatcgagccgtcggatttccggctgtgggtctgcctgcacgaggtcacccaccgcgtccagttcaccgccaacccctggttgcctggctacatgtcgcaggcgctggccctgctgacccgcgacaccggcgacgacctggggcaggtgctgagccggctcgccgactacgcgcgcaaccgcggcaatccggcgtcacaggccgacgcgaactcgaccgggatcctcgggctggtgcgggcggtgcagtccgagccccagcgccaggccctggaccagctgctggtgctgggcaccctgctggagggccacgccgaccacgtgatggacgccgtcggcccgatggcggtgccgtcggtggccaccatccgccgccgcttcgacgagcgccggcaccgcaagcagccgccgctgcagcggttgctgcgcgccctgctggggctcgacgccaagctcagccagtacacccggggcaaggcgttcgtcgaccaggtggtgggccgggtcggtatggcgcggttcaacgccatttggacggggcctgaaacgctgccgctgccggtcgaaatcgaagagccccagcgatggatcgaccgggtgctctagaccggctgcgcaccgcggtcgaggcgttcagcacggcccacctgggtgcggtcgaacgctggtgcgtggcgctgtccggcggcccggattcgctggcgctcaccgccgtggcggcccggctgcggcccaccaccgcggtgatcgtcgaccacggtctgcaaccggactcggcggccgtcgcgcaaaccgcccgggcccaggcaattgcgttgggttgtgttgcggcgcaagtcatttcggttcacgtcgacggcgagggcggcctggaggcggcggcgcggcgggcccgctacgcggcgctggccgcgcaccgcgacgggccggtgctgttgggtcacaccctcgacgatcaggccgagacggtgctgttggggctcggccgcgggtcgggggtgcgctcgatcgcgggcatgcgtccccacgatccgccgtggtgccggccgctgctcgggcagcggcgcgcggtgacccacgcggcatgcgcggagttgggcctgacggcgtggcaggacccgcacaacagcgaccgtcggttcgcccgggcgcgcctgcgcgccgaggtgctgccgctgctggaagaggtgctcggcggcggcgtggtcgaggcgctggcccgcaccgcgacggcgctgcgcgaggacaacgagttgctcgacgcgctggccgagcgggcgctgcccgccgcccgggccggggcggggctgcaggtggcggcgctggccgggctggacgcgcccgtgcggcgccgggtgatccgggcctggctgctggccggcggtgcaacgggattgaccgacaagcagattcgcggggtggacaacctggtcaccgcctggcgcggtcagggcgcggtggcggtggggtcgtcgctgcccggcgagcggctgttcgcggggcgccgcgacggcgtgttgacgctgtggcgcgagccggtccgttaaccgcaatgccggagccgccgttggttattcgcccgccggcgtggcacgctgtgggcgtggcccagatctcctcggcgatcacccccgctcagcccgcggagctgtaccccggggatatcaagtctgtcctgctgacggcggagcaaattcaggcccgcatcgccgaactcggccgcgaaatcggggacaactaccgcgacgccgcgaccgagaccggacaggacctgctgctgatcaccgtgctcaagggcgctgtgatctttgtcaccgacctggcccgggcgattccgctgcccacccagttcgaattcatggccgtcagctcctacgggtcgtcgacgtcgtcgtcgggcgtggtgcgcatcctcaaggacctggaccgtgacatccagggccgcgacgtgctgatcgtcgaggacgtcgtggactcggggctgacgctgtcctggctgctgcgcaacctgagcacccgtcatccgcggtcgctgcgggtgtgcacgctgttgcgcaagcccgacgccaggggcgcccacgtcgacatcgcctacgtggggttcgacatccccaacgacttcgtggtgggatacggcctcgactacgacgagcgctaccgcgacctgtcctacatcggcaccctggacccccgggtctaccagcagtagctcccgctcagtccagctcccaggacgcggtgacggtgaacttcaccgtctgctggcccggttccagcggcaccgccatcggcatcgcgcgcggcgacggtggcgggccgccgggtggcggggcgttgcccgtcgcctccgagatggacagcaccttgcccaggtgcagaccggacagctgggcgtactgctcggcgcggcttttggcgtcgttgaacgcgcgggtgcgggcgtccttgaccagctgcgaatcgtcggcgatggagtagctgaccgatcggattcgggtggcgtcgccgccggtgccgacgatgagggccagcagtcgtgacgcggcgtcgggcgggtggatcttgacggcgacggcgttgctggcgcgatagccggtgatcgcggcgctgccgccggcctcggggttgctgtactggggtgtcagcgcgacctcggtggtgctgatgtccttgtggtcgatgcccgcgccgaccagcgcgttgatgacggcctgctgacgctcgttggtctggttcatcgcggtggtgacatcgggcgcggtgaactcgatgccgacgtcggcggtcagggtgtccggaacgccctggacctggccggaacccaccactgtcacctgccggggcgcggcgccggacggcggcggaccgtgcttgtcgcacgccgagatcgcgacgacggccagcccggcggcggccgccgcgatcgctgagcggacacacttcggggcgttcgttgcgaccggcatgtctggcaccttagccgccgcggcgtcgtccggtttgcttggacgtcacccccgcgtggtgccgccgccggcaaaccgggttggggtggcgcgcgcgactcatataaggacatatatgactccaaacatattggaatacagggctattcatgacaaatccaaaagtcgcagcagcgcggtccagctaagtgaacagttgccgaatcggccatgaattgggtctattcgggctgttctcactggacgcgactgacctaacgtgtccagccggtagccgaaaagtgttcggctgaacgggttttgaggaggggacatgtcatttctgatggtgcgcccggaaatattggatgcggcggcccgggagctgcacggcatcaatgccgcggtgctgcagagcaattcggccgtggtcacgccgacgacggcggtggctccggccgccggcgatgtggtgtcgctggtgacggcggcgcggttctcccggcacgggctagccttccaggaggtcagtgcgcaggccgcgcagctgcgcgaccagttcgcgacaacccttggcatcagcgccggttcgtatgccgccgccgagatcgccaacaccgccgcggtcggctgaggaagcacgatgctggaattcgggcagctggatttcgcgcagctggatttcgcgcagcttccgccggagatcaactccgggctgatgtattccggacccggcgcggggccgctgcggcggcctggaacggcctggccgccgaattacgttccgccgcagcgtccttcgggtcggtgatcaccggcgtgggcgacgccgggtggcaggggccggccgcgtcgtcgatgatggccgcggcggcgccgcagctggcgtggctcagcggcaccgccggacgggcggagctcgccgccggtcaggccctcgcggcggtgagcgcctatgagacggccttcgccgagacggtgcccccaccggtgatcgcggccaaccgtgcgctgctgctgcagttgctggccaccaacttcctcggccagaacaccccggccatcgcggacgtcgaggcgcaatacggcgaaatgtgggctcaggacaccgcggccatgtacgggtatgcgctcgcgtcggccgcggcgtcgacgctgccaccgttcgagccggcgaaacccgcaaccgacccggcggggctggcccgtcaggccgccgcgacggcgcaggcggccgggaccggcgccggtgacagcgcccaaggactcggcgcggcgccgcaacccatgtccacgctggccgcggggaccaacaatccgccgccggccaatccagggttctcgctgggcgggatcagcctgaatcccgagggcgacgggctcgtcatcgggggtccgctgggcgatctgctggaggggctgaccgggtcgcaaaccctggacgccagcacgcctttcgacgcgttcattcggttgatctccccgacgcgactgttcaccacctcgttcaaggacatccagggcattgcccagggcatgatgcccgccgccaagtccgccggcgagggcgtggccaaagccgccgaagcggtcctgcccgcggccgtcccgggcgccggcctgggctcgctgggctcgatcggcgggtcggtcggcaaggcggcatcgatcggcgggttgtcggtcccggcttcgtgggcgagcgcggcccccacgccgccctcggtcgccgtggcgctcaacggggccacgacgaccggcgccgccgagcacgccgccagcgcggtgggcggggtgccgatgatgcccgccggtgccgcgggccgcggcgcgggtgcccacttcgtcgttccccgttacggtttcaaacccacggtcatcgctcaaccgccggccggaggatgatccggcggatcagaagggcgggtcgtcgggcagcggctgatacgccggctcgtcgggcgcccagtccggcggcagttcctccggctctcggggatcgttgacccaggcgcagaaggggctggtgcttggcgcgcccttgaacaggaaaagcatgtcgcgcatgtgatttcggaacttccggtccgcgatctcgcgctgccgggcctgctccagccggatccgggcctcgttgatcggacgctgctcacgattgtgcttgcgcgcccgcatgatccggccgtttcgctgtttcgatctgcttcggcggttgggtgtcggggccgcgcatgccggaccgcgcggctgggcgaacaggtcggcccccgcgggcgacgtccggtacgtccgtccgctcggcgaggtccagaccacggtgccgtcggccagttgcctgtcgcgccacccgccgaaggttttgagccgatgatgttggcggcacaggcatttgaggttctccagcaccgtccacccgccggccaccggattctgatggttgaacggcacggaatggtcgaggtcacagatcaccgccggacggctgcatccggggaagcggcaggtgagatcccggcaccgaacggcccgctccagcgccgccgacggctggtagcgcagggccgccgccgggctggtcgcgggattggcgacgagcaggtgcgcggccgccgccagtcggcgcacctggtcggcgtcgatgacgccgtagccttccaggtagcccggctcggcgccatcggcgtatacggttcggtcgctggccaccacgttgatgaccacccgcgccccggtcccgtcgtctgcatgttggtcgccggttcgagccgggcagtcgggttgtccacaggcgcagggcaatccgcggccctcggccagcgcggccaacgcgtcggcgcggcgctgatccagcgtccggggatccgccgggcatacctgcttggcgagttgggacaaccgccggtcgaacgccgtcgccgcggcggcggcgaccgagccgtgcacctcggccatcccgttctccgcggcgctgatcccgatgtgccggtcctcttcggcggccagccggcgctcgcgcgcggcgtcgggatcggcggtgcgcacggcggcgtcgacggcgttgacgatccgctgccgcgaccagccgtgccagttgccgatgcgggcggcgagcgaccggtcaagcttggcgatcaattccgtgtcggtgaccagactcgtgcgggtgatgatcaatcgtactgtgcgccaatcggttcggccctcggcgagcagcgccgccacctccggcagcctggtgtcgagcgtctcggcgtaggacaccaggtagctggctgccgccgcggagaggttcatcgccgcggccacctcggcggcggtctgctcgaagccgtcgatctccgcatactccggctccgggcggtcggtggtggccacccggtggcgaagcaacgccgccacggccgcgaaccggcgcgccaccagcatcgactcctcgcgatgggtggactcgatcaccgccaccaacgcagccggatccgggcccgattcgaacatatgttcgagtatagcaccccgctaagacatcagggcgtgacgagaaccttgcagtgccgctcgggatcggcgaggtcgtcgaacgccgcgccgaccccgtccagcccgacctcgccggtgatcagcggcgccacgtcgatgtcaccctcggcgagcgcgcgcagcgaatcgccgaactcctcgggggtgtaggcgagcacgaactgcacgttgatctccttggcgatcgcgaagaaggggtggacggtgtcgggctgcatgcacacgccggcgaccaccagccgggtgccgggcctggcgcgcagcagcacgtcgtcgatgatgccgggtacgccgaccgcctcgaacaccaccgcgggcttgacgctgtcgaacggcgagccctgcgcgggatccagcgtccggtgggcccccatcgcggtggccagctggcggcgcttgggcgaaaagtcggacgccacaatcgattccacaccgcgcgtggcgagggcggcgatgatggcgatcccgatcgggccgcacccgagcaccagggcggtctcggccggggtgatgttcgatttgttgaccgcgtgcagtccgaccgccatgggttcggtcagcgccgcgtgcttgacgtccaggccgttggggatgggcagcagcagcggcgccgagagcagcatccgctcggcatagccgccgatcgtggtgttgctgtagacgatcggctcgacgcccttggcggacaacaacaccggcagcgaggtgaccaaagtgcccgggggatgggtttcggtgtcggggcccgcttcgagtatctcggcgctgaattcgtgtcccatgaagatgtcgtggtccaggtcgacgcgcatgccgcccgcgccgccggccacccgatcgctcatctgaagcacctgggcgccgtgggcggcgaaatgcaggtccgagccgcaaatcccgcacgcccgcaccccgacgagcacctggccggtttcgggtatcggttcgggcacgtcgtcgcggtagaccatgcgaccgtcgcgcaacaccgccgcgcgcatcagtgcaccgcgtccttgtgctcgtcgacatgttcgctgatcgccttgaccacggcctcacccgcccggccgagcaactggtcgcgcatgcccttcgcccagtcgtgcgatgcgcgcgaggcgtcgagctgccgcttgaagtgcggaatcaccttgcgcgccatcaggtcatagcagtggtatgtcgcttccggtgaggcccagtcatggcccagcatcaacagggtgccgaaaccgccggaccggtccagcaggtcctcgatgtgggcgatggcgtcctcgggcgtgccgatgcagcagttgcccttggccgcgtactcggcgacgaactcgtgcggcgtctgggtgccctccacgctgttggccagcgggacgaagccggccgcgccgaagtagttcgcgaaatcctgtaggccgtaagtgcaatcgtcgatcgcctgctcgcgactgtccgcgatgtgcatgatgctcaagacgcgccagtcgccgcggtccggttcgtcccggccggccttggcggcctgctcgcgcaccacgtcccaggtggtctccagcgccgcgtaaccgccgggcaccgacatcgacagcgacagcagcgaggtgcccagcgcgccggccaaccgcggacccgagggggaaatcattgcggccgtggatatctcggggtacggccaggtgtagggccggatgtgcaactgggcgtcacgcagcgtgaaccagtcggagtgacggtcgattcgctcggtgggggcggcgcggaacagcgccaggatcgcctccagcgattcctgcatcatgtgccgctgatcgacggggtcgatgcccatcatgtaggcgtccgacggcagcgcgccgggcccggtgccgaacatcacccggccgcgggtcaggtgatcgagcagcacccagcgatcggccaccatgagtggatggtgatagggcagcgacaccacgccggtgcccaaccgaatgtgtttggtccgctcggccgcggtggcgatgaacacctccgggcaggcgatcagttcgtagccgccggagtggtgttcgccgaaccacgcctcgtcgaatccgagccgatccagtgctaccacccgttccaggtcgtattccagtgcgaccgttggggattggccgacggggtgaaacggggtgatgaagacaccgaaccgcaggggcgcgctcatcgcagctccaatccgttgaggaattccagtaaggccgcgttcacctcggcggggcgctcctgctgcagccagtgcccggcgccgtcgatcatcacctgccggtacgggccggagatcacctccgccgcgcggtcggcccgggtgaaggacaggacgggatcggccgtcccgccgatgaacaggcacggcaccgcgatcttggcgccgtcgagttcgggggtggtctcccagttgcggtcgaaattgcgataccagttcaggccgccggtgaagccggtgcgcgagaattcggcgatgtagtggtccagctcgtcctggctgatccactccggcagcccgtcgggctcgggaaggcgttcgaggaaaccctccggacccggcgccaccatccgcagccccgccgccttgtcgccgtcggtccgcaggctgcccatcatccgtcgcatcacctgcgcgggatcggcattcaactcggcgtcggccaccccgggctcctggaagtacaggatgtagaagaagttctcgccgaacatctttcgccacgcctgcgtcggcgccacccgcggccggggcgtcaccggcacgctcatggcggcgacggccgcgacccggtccgggtgcagcagcggcgcattccacaccaccgccgcaccccagtcgtgccccacccatacggcgcgctgcgcgcccacgtcgtcgagtaggccgacgaggtcggcggtcaactggtgaatgtcgtaggcctcgacggcatccgggcgatccgaaccgccgtagccgcgctgatcgggcgccagcacgtggtagccggcgttggcgaggacgtcgatctggtgtcgccaggagtaggccagttcggggaatccgtgggccaggatcaccacgggtgcgccgcggtcgcccgcttcggtcacccgcagccgcacaccgttggtgtctactaaccgttgggtagggggcaccgtctcaccaaagcacaacggtcgcggacagagaagggcccaattgacgcgaatggcggtgggttgcgcatcaaatggccgcaacaccgcaatactcgggtttatgcgcctggaccatgtcgtgctgtggaccagaaatccgcgggtgtcgatggacttctacacgcgcgtcgtcgggctggaaccggttcggttcgccgaattcgaggccggcgaggcgccgttccccagcgtgcgcatctgcgcggactcgatcatcgacttgatgccgctcgagatggtttccggcgccgcgtcgtccggggtcgccgagggcagcgccggtaaccccgtcaaccacgtctgtattgccttgtccaaggccgaatacgacgcgctggaggcgcgcctgcaggccgagggcgtggacaccggcgtgcgcctgagccggagtttcggcgcgcggggctggtcgccgcacacctactacttcgccgacccggacggcaacgtcgtcgaggcccgctactacgagtgacgggcccggccgcagcgccgagcgtcacgcaggagtgacaccggccgccgacggcagcgccagcgtgacgctcgggaaccgccggtcgttgctattgactgaggacgctgcgccccggctctgccggagctggcgatcgccgctgagcacgacggcggcgacccgctgcgccccggctctgccggagctggcgatcgccgctagcggtagcctggacttttccagctgcgtgtatatcggggaaggacccgcccagtaagggccgatgattgatgaaccggaaaaacgttattcgcaccatcacggcgattgctgtcgtggtgctgctcggctggtcgttcttctacttcagcgacgacacccgcggctataagcccgtcgacacctcggtggcgatggcccagatcaatggcgacaacgtcaagagcgcgcaaatcgacgaccgcgaacagcaactgcgcctgaccctgaagaagggcaacggcgacaccgacaactccgacaaggtcatcaccaaatatcccagcggctacgcggtcgacctgttcaacgcgctgagcgccaagaacgcgaaggtcagcacggtcgtcaaccagggcagcatcctgggcgagctgctggtgtacgtgctgcccctgctgctgctggtcgggttgttcgtgatgttctcgcgcatgcagggcggcgcccggatgggcttcgggttcggaaagtcgcgggccaaacaactctccaaggacatgcccaagaccacgttcgccgacgtcgccggggtcgacgaggcggtcgaggagctctacgagatcaaggacttcctgcagaacccgggccgctatcaggcgctgggcgccaagatccccaagggcgtgctgctctacgggccacccggcaccggtaagacgctgctggcccgggcggtggccggcgaggccggggttccgttcttcaccatctccgggtccgacttcgtcgagatgttcgtcggggtgggcgcgtcccgggttcgtgacctgttcgaccaggccaaacagaacaacccgtgcatcatcttcgtcgacgagatcgacgcggtgggacgccagcgcggcgccggcctgggcggcggtcacgacgagcgcgagcagacgctgaaccagttgctggtcgagatggacgggttcgacccgcgggccggcgtgatcctgatcgccgccaccaaccggcccgacatcctggacccggcgctgttgcggcccggccgcttcgaccgccagatcccggtttccaacccggacctggccggccgccgcgcggtgctggcggtgcattccaagggcaagccgatcgcccccgacgccgacctcgacggcctggccaagcgcaccgtcggcatgaccggcgccgacctggccaacgtgatcaacgaggcggcgctgctgaccgcacgcgagaacggcaccgtcatcaccagcgccgctttggaggaagcggtcgaccgggtgatcggcgggccgcgccgcaagggccgcatcatcagcgagcaggaaaagaagatcaccgcctaccacgagggcggccacacgctggcggcctgggcgatgcccgacatcgaacccatctacaaggtgacgatcctggcgcgcggccgcaccggcgggcacgcggtcgcggtgcccgaggaggacaagggcctgcgcacccgctcggagatgatcgcgcagctggtgttcgcgatgggtggccgcgccgccgaggagctggtcttccgcgagccgaccaccggcgcggtgtccgacatcgagcaggccaccaagatcgcccgcgcgatggtcaccgagttcggcatgagctccaaactcggtgcggtcaaatacggttcggaacacggcgacccgttcctcggccgcaccatgggcacccaggccgactactcgcacgaggtcgcccgtgacatcgacgacgagatccgcaagctgatcgaggccgcccacactgaggcctgggagatcctcaccgaataccgcgacatcctcgacacgctggcgggccagctgctggagaaggagacgctgcaccgcgctgagctggagagcatcttcgcgggcgtcgaaaagcggccccggctcacgatgttcgacgatttcggtggccgtatcccgtcggacaagccgccgatcaagacacccggcgaactggccatcgagcgcggcgagccgtggcccccgcccgcccccgagccggccttcaaggcggccatcgcccgggccagcgaggccgccgcggccgcccggctggaggccgaccgaaacgccaacggcggcaacggttctcacgccaaccagggcggtaatcggcagggccccacccaacccgactacggtgcgccggcgggctggcgggcgccgggctggccgccgcagcagtcgcagcagcccaactactggcacccgcccgcccagccgccctactggcagcaaccggcgcacggctacccgggccagcagccctacccgggccagcagccctatcccggccagccgggcggaccggctcagtccggcccaccccaggcgcgtccgccgtacccgccgtacccgccgtatccgccgcccggtcagcccgcccccgagggtgggtcgccggaccggcaggatgacgacgtgagccggtccaacccgccggcccacggctgagcaaacggaggatgtgatggccgggaacggttcagcgccggacaccgcgacgcaccaggtccggcagttcgaccaggcgcgcgccgaggccgccgtccgcgagttgctgttcgccatcggcgaggaccccgaccggcacggcctggccgaaaccccggcccgcgtcgcccgcgcctaccgggagatgttcgccggcctgtacaccgacccggacagcgtgctgaacaccatgttcgacgaggaacacgacgaactggtgctggtcaaggagatcccgctgtactccacctgcgagcaccacctggtgtcgtttcacggggtggcccatgtcggttacatccccggcaacgacggccgggtcaccggcctgtccaagatcgcccgcctggtcgacctgtacgccaagcggccccaggtgcaggagcggctgaccagtcagatcgccgacgccctggtgaaaaagctcaatccgcgcggggtgatcgtggtggtcgaggccgagcatctgtgcatggcgatgcgcggtgtccgcaaacccggtgccgtcaccacgacgtcggcggtgcgcgggctgttcaagaccaacgcggcttctcgggcggaggcgctcgacctgatcctgcgtaagtgagtccggcgccttgcaggtaatgggagtcttgaacgtcactgacgattcgttctccgacggtggccgctacctcgaccccgacaaggccgtcgcacacggactggcgctggtcgccgagggcgccggcatcgtcgacgtgggcggcgaatccacccgccccggcgccacccggatcgacccgcgcgtggagacctcccgcgtcgtcccggtcgtcaaagcgcttgcggcagaaggtgtcacggtgagcatcgacaccatgcacgccgacgtcgcgcgggcggcgctgggcagcggcgcgcggatcgtcaacgacgtgtccggcgggcgcgccgatccggcgatggcgccgctgctggccgaggcgaaagtgccctgggtgctgatgcattggcgatcggtgtcggccgagcgcccgcacgcggcgccgcagtaccgcgacgtggtcgccgaggtgcgcgccgaactgctggccagcgtcgacgccgcggtggccgccggcgtcgattccgcccggctgatgatcgatccggggttgggattcgccaagaccggacaacacaattgggccctgctgcacgcgttgccgcagttggtcgccaccgggatcccggtactgctgggcgcctcccgcaaacggttcctcggcacgctgctggccgggcccgacggcacgccacggccgcccgacgggcgggagacggcgaccgcggtgatttccgcgctggccgcgctgcacggggcgtggggggtgcgggtgcacgacgtgcgggccacggtcgatgcgctcaaggtgctcggcgcttggatgggagacgatggctgatcgaatcgagttgcgcggcttgagggttcgcggacaacacggagtgttcgaccacgagcgcgtcgacgggcaggacttcgtcatcgacgtcacggtctggatcgacctggtgggcgccgcggccagcgacgagctggccgacacctacgactacgccgcgctggcgcagttggccgccgacgtggtggccggcccggcacgcaatctgatcgaaaccgtcggggcgcagatcgccgaccaggtgatggacgacgaacgtgtgcacgccgtcgaggtggtggtgcacaagccgcaggccccgatcccgcagcagttcgccgacgtcgcggtggtggtgcggcggtcccggcgcggcggccgcggttcggtggtcccggcgggcggggcgctatgacacgcgacgacgacgatgacgccggcgcagccggggttgaggagcggcgccaatgacacgcgacgacgacgatgacgccggcgcagccgcggttgaggagcggcgccaatgacacgcgttgtcttatccatcggctccaatctgggggaccggctggcgcggctgcagtccgtcgtcgacgggctcggcggcgcggtgcgcgccatctcgccggtgtacgaaacccaaccctggggccgggtggatcaggcgccgtttctcaacgcggtgctgatcgccgacgacccggcctgcgacggccagggctggctgcgccgggcgcaggaattcgagcgggcggcgggccgggtgcgcggcgaacgctggggcccgcgcaccctcgacgtcgacctgatcgcctgctacggcgacggcgaggtgatctcccgggagaacaacctgaccctgcctcatccgctggcgcatctgcgggccttcgtcctgatcccgtggctggccgtcgacccggacgcgcagctgacggtggccgacgggccgcaaccggtcgcccgcctgctggcccagctggaccaggccgaccgggacggtgtccggccgaccggcctgacgctgacaccgcccgcgggctcgccggccgattcgggggcgggcagctgatgggccccacccgcaagcgtgacctgacggccgcggtggtcggcgctgccgtcgtgggttatctgctggtccagggcctgtatcggtggttcccgccgatcacggtgtggaccgggctgtcgctgctggccgtcgccgtcatcgaggcgctgtgggcgcgctacgtgcgcaccaagatcaacgacggcgagatcggctccggtcccggctggctgcatccgctggcggtagcacgcagcctgatggtggccaaggcgtcggcgtgggtgggcgcgctggtgctgggctggtggatcggagtgctggtgtactttctgccgcgccgctcctggctgcgggcggccgccgaggacacctcgggggcggtggtggcggccgtcagcgcgctggctctgctcgtcgccgcgctgtggctgcaacattgctgcaaatccccgccggactccggcgagcacggcgagggcgcggaaacctagccgacccggccgcggcgcgggcaacccgcaaagaatcgccggagtcggccgacacgctgattgacctcgcgcaggtacagtttggccatgaccgttctgtcccgcggcgcccgggtccggcgcggcggccgcaggccgggttgggtgctcttgaccgcgttgctggtcctcgcgatgggggccagttccgcattggttttcaccaatcgggtggaactcctcaagctcgctgtaatcctggcgctgtgggccgcagtcgccggcgctttcgtctccgtgctgtatcgccgccaaagcgacgccgaccagtcccgcgtccgcgacctcaaactggtctacgacctgcagctggaccgtgagatctcggcccggcgcgaatacgagctcacggtggagtcccagctgcgccgcgagctcgcctccgagctgcgcgcccaggccgccgacgacctggccgagctgcgcgccgagctgagcgccctgcggaccagccttgaaatcctgttcgacaccgacctggggcagcgcccggcgctcggggcgttcgagggcgagccgcaacccgagcgggcgtacagcgagtgggagcgcaacggcgagaacccccgcgacacgccggtggattgggtgcccagcgatcgggtgacctcggcaccccaggagcatccgcccggacggcacgacgagacggccatcatcgacgtgcccgaggagccgctgatgccgccccgcccgcagcagccagcgccactgcggcgcgagcgtccccgctaccaggagcccccggggccgacggagccgcggttcgagccccggtatcaacccccgccggccgctgccgcgacgccacctccgccggaaacgccgccggaacccccgcgcgaaccccagccggaaccgcaacccgaaccccagccccagccgcagggccgcgactggcagcccgtgggcgccgaggggcagtggttgccgcccggatcaccgggcagcaactgggccggcgccgacgcggagtcgacgggtggacgccggcgtgcccggcattcgggcgccgacgaggcctgggacggcatgcccgtcgagcccgtgcccccgccgccgtacgccgagtccggtcgccgggcccgctcgcgccattccgcggagtaccgcgactacggggtgcgcaacttcgcgcccggcagcgagccgccggccggaccggcccccgcgccgcctccgcccgccgcggccacaccgccgcccccggccgctccggcgccgtccggaccggccgctggtgcatccccaccaccgcggctggcgccgccgccggccgccgagcacacgccgcggcacggcggggagccggaaccggccgacccgcggcgggcgcgggacgcctccggcaccgggggccagtcggtggccgacctgctggcccggctgcaggtgcagccgtccgagggcggccggcgccggcgccgcgagggctgagctgggagcttcctcacattgggggatgcgagctgatcgactaggattcgagtgaccgaacggtacccacctgcgtgggaccggaacgaaccagaaatctgtgaggtcgtctgcgatggtgcagttcgacggtctgcgcccggccaggctcaaggtgggcatcatctcggccggccgggtgggcaccgcgctcggtgtcgcgctggagcgcgcggaccacgtcgtggtggcgtgcagcgccatctcccatgcgtcccggcagcgggcacagcgccggctgcccgacaccccggtggccacgccgccggaggtggcggccggtgccgagctgttgctgctggcggttcccgacagcgaactcgccggcctggtctccggtttggcggcgacggaggcggtgcgggccgggaccatcgtggcccacacctcgggcgccaacggggtgggcatcctcgcgccgctgacccggcagggctgcatcccgctggcgatccacccggcgatgacgttcaccggctccgacgaggacatcagccggctgccggacacctgcttcggcatcacggcggccgacgaggtcggctacgcgatcggccagtcactggtgctggagatgggcggggagccgttcagcgtcgccgaggacgcccgcgtgctctaccacgccgcgctggcgcacgcgagcaaccacctcgtgacggtgctgtccgacgcgctcgaggcgttgcgggccgcgctgcgcggcagcgaactgctcggccagcagaccgtcgacgagcagcccggcggcatcgccgaacgcatcgtcgggccgctggcccgggccgcgctggagaacaccctgcagcgcgggcaggccgcgctcaccggcccggtcgcccgcggcgacgcggccgcggtggccgggcatctggccgcgctgcaccgggtggcacccgagctggcacaggcctatcgggtcaacgccctgcgcaccgcccagcgggcgcacgctccccaggaggtcgtcgaggtgctggcaccgtgaaacccgccttcaccgcgggcgaactcaacacctacaccagcccgggcgacgtcaccgccgtcagccgcgcgctgcgccacaccggccgccgggtgatgctggtgcccaccatgggtgcgctgcacgacggccacctcgcgctggtgcgggcggccaagcgggtgcccggttcggtggtggtggtgtcgatcttcgtcaacccgctgcaattcggcgccggcgaagacctggacgcctacccccgcaccctggacgacgacctggcgctgctgcgctccgagggcgtcgaaatcgccttcaccccaacggccgcggcgatgtacccgaatggtttgcgcaccaccgtgcagcccggcccgctggccgccgagctggagggcgggccccggccgacgcatttcgccggcgtgctgaccgtcgtgtgcaagctgctgcagatcgtgcgcccggaccgaatcttcttcggcgagaaggactaccagcagctggtgatgatccgtcagatggtcgccgacctcaacatcgacgtgcaggtggtcggggtgccgaccgtgcgggaggccgacggcctggcgatgtcgtcgcgcaaccgctacctggacgccacgcaacgcgaactggccgtgacgctttcggcggccctgaccgccggcgcgcacgccgctcacctgggcggtgcggccgcgctgcgggccgcgcgggcggtgctggacgccgtgcccgagctcaccgtcgactatctcgagctgcgcgacgccgggctgggcccggcacccgcccacggctcggcgcggctgctggtcgccgcccggctgggcaacacccgactgctggataacatcgaaatgcagatcgaaacacccgccggcaccgctgggccggacggcgaccgccaatacgcccaatcaccttggaggaattgatgttacggacgatgctcaagtcgaagatccaccgggccaccgtcacgcaggccgacctgcactacgtgggctcggtgaccatcgacgccgacctgatggacgccgccgacctgctcgagggcgaacaggtgaccatcgtcgacatcgacaacggcgcccggctggtcacctacgcgatcaccggtgagcgtggcagcggggtgatcgggatcaacggtgccgcagcgcatctggtccacccgggcgatctggtcatcctgatcgcgtatgggaccatggaggaggccgaggcgcgggcgtatcagccgcgaatcgtcttcgtcgacgccgacaacaagccggtcgacctcggccacgatccggcattcgtgccggacttcgagatagcaggggcggccgagctgctcgatccccggatcgttgcgcggtagccgtgctgctggccatcgacgtccgtaacacccacaccgtcgtcgggctgatatccggctccaaagagcacgcaaaagtggtgcagcagtggcggattcgcaccgagtcggagatcaccgccgacgagctggcgctgaccatcgacggtttgatcggcgacgactcggagcggctcaccggcgccgccgcgctgtcgaccgtgccgtcggtgctgcacgaggtgcgcctcatgctcgaccagtactggccgtcggtgccgcacgtgctgatcgagcccggggtgcgcaccggcatcccgctgctggtggacaaccccaaggaagtgggcgccgaccggatcgtcaactgcctggccgcttttcaccgtttccaaagccccgccatcgtcatcgacttcggatcctcgatctgcgtggacgtcgtgtcggccaagggcgaattcctgggcggcgcgatcgcgcccggactgcaggtctcctccgatgccgccgcggcccgctccgccgcgctgcgccgggtcgagctggcccgcccccgctcggtgatcggcaagaacaccgtcgaatgcatgcaggcgggcgcagtgttcggcttcgccgggctggtcgacggcctggtcgggcgcatccgcgaggacgtgccgggattcggcggcgacgacgtcgcgattgtggccaccgggcacaccgcgccgctgctgctgcccgaactggacaccgtcagccactacgaccagcacctgaccctgcacggcctgcggctggttttcgaacgcaaccgggatgcgcagcgcgggcggctgaaaacggcccggtgacggcgtcgggcgcggcctggcggccgcgtcatttaagctggcacgtcgtgagtcccgccccagacgccgacattcccgagcagtaccggatccgccgggacaagcgcgcgcggctgctcgccgaggggcacgacccgtacccggtcgccgtcgaacgcacccacacgctggcgcaggtgcgcgccgcccaccccgacctgcccgtcgacaccgcgaccgacgacgtggtcggcgtcgccggccgggtgatcttcgcgcgcaactccggcaagctgtgcttcgccacgctgcaggagggcgacggcaccaccctgcaggtgatggtcagcctggacaaggtgggccgcgaagccctggacgcgtggaaggccgacgtcgacctgggcgacatcgtctccgtgcacggcaccgtgatcagctcccggcgcggcgaactgtccgtgctcgccgactcgtggcggatggcgtccaagtcgttgcgtccgctgcccgtcgcgcacaaggagatgagcgaagaggcgcgggtgcggcagcgctacgtcgacctgatcgtgcgcccgcaggcgcgcacggtcgcccggcagcggatcgcggtgatccgggcgatccgcaacgccttggaacggcgcgggtttctcgaagtcgaaaccccaatgttgcagacgctggccgggggcgcggccgcgcggccgttcgtcacccattccaatgcgctcgacatcgatctctacctgcggatcgctccggaactgttcctcaagcgctgcgtcgtcggcggtttcgataaggttttcgaactaaatcgcgtgttccgaaacgaaggtgcggattccacccattctccggaattctccatgctggagacctaccaggcctacggaacgtatgacgattcggcggtggtgacgcgcgagcttattcaagaggtggccgacgaggccatcggaacccgacaactaccgctgcccgacggcagcgtctacgacatagacggagaatgggcttctatagaaatgtacccgtcgctgtcggcggcgctcggtgaggagatcaccccgcagaccacggtggaaaagctgctcggcatcgccgagcggctgggcgtcgagatcccccgcgaccgcggctacgggcacggcaagatcgtcgaggagctgtgggagcacaccgtgggcgacacgctcaccgcgcccacgttcgtgcgggatttcccggtcgagacaacgcctttgacgcgtcagcaccgcagcatcgacggcgtcaccgagaaatgggacctgtacgtgcgtggggtcgagctggccaccggctactcggagttgaccgatcccgtggtgcagcgcgagcggttcgccgcccaggcgcgtgcggcggccgccggcgacgacgaggccatggtgctcgacgaagactttctcgccgcgctcgagtatgggatgccgccctgcaccggaacgggaatgggtatcgaccggttgttgatgacattgaccgggctgtcaattcgggagacagttttgttccccatcgttcggccgcattcgtagttgaaagtgcaacgccgcagaaagtccaaccctgcggcgtccgtacagattgagtatgctgcgctgttatggcagattggtgaccggggaggtcgatccaatctgctcagcaactgctcaggacgaaatgcgagggtaagccaatggcaaaaaaagtgaccgtcaccttggtcgatgatttcgacggtgccggcgcagccgacgaaacagtggaattcgggcttgacggggtgacctacgagattgacctttcgtccaagaatgccgcgaaacttcgtaatgatctgaagcaatgggtggaagccggccgtcgcgtcggcggccgccggcgcgggcgctcgggctcgggacgcggccgcggcgccatcgaccgcgagcagagcgcggcgatccgcgaatgggcccgtcgcaacgggcacaacgtgtcgacccgcggccgcatcccggccgacgtcatcgacgccttccacgccgcaacctgaccgtcctgcagccggcgcccgggcgtgcagtccgggcgccggtttgtcgtttcgctggccgcgaaatggtcggcgggtggcgccggaaacgaattggcgcaccgcggcgtttcttcagttacgcgcacaacgccgcaggcagccgcggccgtgattgcatcgcaacgacggcgcacgtccgactacgagcaaggcggcgcaaggttaggcccgccggcaagccgaccattacagtggatggcaggtacgcgattccggccacaagggaccggcagggttgccagaagggccgctaacaggtttgtaccgatggtgagggagagcaggtaaccaccgatgtttgaacgatttaccgaccgcgcccgcagggtcgtcgtcttggcgcaagaagaggcccggatgctcaaccacaactacatcggcaccgagcacatcctgctgggtttgatccacgagggcgagggcgtggcggccaagtcgctggagtcgctgggcatctcgctggagggcgtccgcagccaggtcgaggagatcatcggccagggccagcaggcgccgtccggacacatcccgttcaccccgcgcgccaagaaggtgctggagctgagcctgcgcgaggcgctgcagctcggccacaactacatcggcaccgagcacatcctgctgggcctgatccgcgagggtgagggcgtggccgcccaggtgctggtcaagctgggcgccgagctgacccgggtgcgccagcaggtgatccagctgctctccggctaccaaggcaaggaggccgccgaggccggcaccggtgggcgcggcggcgagtccggcagcccgtccacgtcgttggtgctcgaccagttcggccgcaacctgaccgccgccgcgatggagggcaagctggacccggtcatcggccgcgagaaggaaatcgagcgggtgatgcaggtgctgagccggcgcaccaagaacaacccggtgctgatcggcgagcccggcgtcggcaagacggccgtcgtcgagggcctggcgcaggccatcgtgcacggccaggtgcccgagacgctgaaggacaagcagctctacaccctggacctgggttcgctggtggcgggctcgcgctaccgcggtgacttcgaggagcgcctgaagaaggtgctcaaggagatcaacacccgcggcgacatcatcctgttcatcgacgagctgcacacgctggtcggtgcgggtgccgccgagggcgcgatcgacgcggccagcatcctcaagccgaagctggcccgcggcgagctgcagaccatcggcgccaccacgctcgacgagtaccgcaagtacatcgagaaggacgccgccctggagcgtcggttccagccggtgcaggtgggtgagccgacggtggagcacaccatcgagatcctcaaggggctgcgcgaccgctacgaggcgcaccaccgggtgtccatcaccgactcggcgatggtcgcggccgcgacgctggcggaccgctacatcaacgaccgctacctgccggacaaggcgatcgacctgatcgacgaggcgggggcgcggatgcggatccgccggatgaccgcgccgccggacctgcgcgagttcgacgagaagatcgccgaggcgcgccgggagaaggaatcggcgatagacgcccaggacttcgagaaggccgccagcctgcgcgaccgggagaagcagctcgtcgcgcagcgcgccgagcgcgaaaagcagtggcgctccggcgacctcgacgtggtcgccgaggtggacgacgagcagatcgccgaggtgctgggcaactggaccggcatcccggtgttcaagctgaccgaggccgagaccacgcgcctgctgcgcatggaggacgagctgcacaagcggatcatcggccaggaggacgccgtcaaggcggtctccaaggcgatccgccgcacccgcgccgggttgaaggaccccaagcggccgtcgggctcgttcatcttcgccggcccgtccggtgtcggtaagaccgagctgtccaaggcgctggccaacttcctgttcggcgacgacgacgcgctcatccagatcgacatgggcgagttccacgaccggttcaccgcctcgcggctgttcggcgccccgccgggatacgtcggctacgaggagggcggccagctcaccgagaaggtgcggcgcaagccattctcggtggtgctgttcgacgagatcgagaaggctcaccaggagatctacaacagcctgttgcaggtcctcgaggacggccggctcaccgacggccagggctgcacggtcgacttcaagaacaccgtgctgatctttacctcgaacctcggcacgtccgacatctccaagccggtcggcctgggcttcacccagggtggcggtgagaacaactacgagcggatgaagcagaaggtcaatgacgagctgaagaagcacttccgcccggagttcctcaaccgcatcgacgacatcatcgtcttccaccagctgactcgcgacgagatcatccggatggtcgacctgatgatcacccgggtcgccggccagctcaagagcaaggacatggacctggtgctcaccgacaaggccaaggccctgctggccaagcgcggcttcgacccggtgctgggtgcccgcccgctgcggcgcaccatccagcgcgagatcgaggaccagctctccgagaagatcctcttcgaggaggtcgggcccggtcagatcgtcacggtcgacgtcgacaactgggacggcgaaagcgccggcgaggacgcggtgttcaccttcaccggtacccgcaagccgccggccgagccggacctggccaaggccggggcgcacagcgccgacccgcagtagcgcatcaacggaaaacgggcggtggtcttccgggactgccgcccgttttcgctgtgctctacactgacggctgtcatcgacgtgccacggaatttggtgaaactccaaaacggtcgcgccactgtccacagtcagacccgaggcccgtcatcccccacggggacgcgttaatccccggaaggagtcgattgtgtcccacccgcagccgacgcgcagccgcaccaggtcggtcgatctgtccgccgccggaaccgcgctcttcctggccgccaccgtctttttcgcgttgctggcgctctacctcgtcggcgtcgaccagggggcggtgtcgctgttcggcagcgactcgcacgtgcacgaattcatgcacgacgcccggcacctgctcggcttcccctgccactaacgggggagcggcggcgtggaaaaacgcctgatcggggccggcctgctggcgggcgccgtcggggcggtgccggcgttcgtgttcgcccggctgtgcgccgaacccgtcatcgcccgcgccatcgcctttgaggacggccgcgccgacgcggagaacgcgcacggcgtgcacgagcacggcgccgagttgttcagccgtggggtgcaatcgggacccggcctggggttcggggtgctgatcttcggcctggccatgggcgcgttgttcgcggtgctgttcagcgtggtctatccgcgcacggaaagcatttccccccaagcgctttcgctgctgttggcggccggtgcgttcggtgcggtgtacctggtgccgttcgtgaagtatccgccgaaccccccggcggtcggtcaggccgacaccatcggcgcgcgcaccggctggtatctggcgctggtcgcggcgtcggcggcgctgacgatcggcgcggtgtggctggcgcgccggctgcaggcccggctcggcccgtggaacgcgcggctgctttcggccgcggcgtatctggtggcgatcgtcgcggtggcggtgctggcgccgtcggtggacgagacgccggcgccgctgcgcgatgccgccggcgccatcgtctatccggggttccccgccgacgtgctctacgaattccggctggtgtcgctggccgcgcagctggtgctgtgggcgggcatcggcctggttttcgcggcggtcagcgggcggctgctcggggcgcgggcgccacgcgtcccggcgtgaccggggtcgtgcggctgacgctcgtttcgcatggcatgacggatgccatggcggacgggcgttttcccgccgacgagccgctgaacgagctgggccgccgtcaggtgcaacctatcgccgcccaactcggcggcgccgcaagctatttcgtcgcacccgagctgcgcacccggcagaccgccgggctgctcggctgcgacggggcgcccgaaccgctgctggccgacctggattgcgggcggtggcgcgggcgggcgctgcagaccgtggacgaagccgacctggcggcgtggctgagcgatccggccggggcgccgcacggtggcgagtcgatcgccgacctgatcgagcgggcgtcgcgttggttgaatgcgttgaccgccaaccccttacacaccgcggcggtgacgcatccggcggtgatccgggcggcgctgctggcggcgctggacgccgacccggcgtcgttttggcgcgtcgatgtcgcaccggcggcctgcgtcgtcatgcatcaccggggcggtcggtggacgctgcggttgtgaatcgttacgccgcccgcgctgcgggaccatgcggcttctcgcaacggcgacagcgccgacgctatccgagtgagacaccacgacccgacccatcgggacggcgcacgccaaacttgacacatgtcaagtttggcggcaggatggtcgtccacgagcgcaaccaacagcgtgtcgctcaggtaggaggtctgttatggccaaccgctacctgcagggtccattcgccccgatgcatcacgagtacacgctgaccggtttggaggtcgtcgggacgatcccggattacctggatgggcggtatctgcgcaacggtgccaacccaatcggagacgtcgatcctgagcgttatcactggttcctgggcgacggcatggtgcacggcatccgaatccgtgacggcaaggccgagtggtaccgcaaccgttgggtgcgcagcccagccacctcgaaagccctcggccagcccgcaccgccgggtcacttcggcttttttccaatcggcgccaataccaacgtaatcgggcatgccggcaagacactcgcattgatcgaaggcggcatcgccaactatgaactcaccgaggaattggacaccgtcggcgtgtgcgacttcgccggaacgctcaccggcgggtacgcagcgcacccccatcgtgaccccgagacgggtgagctgcatgcggtttcgtacaacccctatcgcggcaacagggtgcagtattcggtgatcgacgtcgagggtcgagcgcgacggaccgtcaacgtcaccgttggcggcagcccgatgatgcatgacttttccctgactgaacgctatgtcgtgttctacgacctgccggtcaccttcgatgaggcggtgggcgcggccatgacggcgccgcgcgggcttcggccgatcgcccggctgatgctgtcggcgctgatcggccgggtcgccattcccgatcccatcgccgcgcggctgccggcggcgaccacggaccggcgaatgccctactcgtggaacccgaactacccggcccgtgtcggcgtgatgccacgcgacggtgaagatgccgatgtgcgctggttcgacgtcgaaccgtgctacgtattccatccgatgaatgcctacgaagaggatggcaccatcgtgctcgacgtagtgcgaaaccccaagatgttcgaccgggaccgcaccggtcccaatgaggggccacccacgttggaccgttgggtgatcgatttggcggccgggaaggtgcgcgaatcccgcattgatgatcggggccaggagtttccgcgcatcgacgagcgcctggttggaaagcggcatcgttacggctacacgccgacggtgctggagggcatcgaaggcggggactgcttgctcaagcacgatcttattggcgggagcacccagtcgcgctgcctgggtccgcaaaaagcattgggcgagtttgtgtttcacccttcatcgccggccgccgcggaagacgagggcgtgctgatgggctatgtgtacgaccgggccaccaatcgcagcgagttggcgatcctcgatgctcaaaccctcgaggacgttgccagcatcaagctgccgcatcgagttcccgccggtttccatggcaactgggtgcccagcaccaactagcggccgccgcgactagcgcggcgcgatcagcgcgaaggcctgtttggccacctgcagcatccagcccgtcgcggtcgggccgtgatcgcgcggccagttcagctggaagctgaccacccacggctgatgcgtcttgtcgaccgcgtaccagctgaacgtcaaatcccccggcagcccaccggctttcgcgccgatgtagggccacaccgccgggtccagctggatgcccgacaccgcggacaggatgtcgcgcaccggtgcggccttgcccaccgcgtcggcctgcagcgccgcgtgcacccggcagatgtcctgcgcgttgccgtaccactccgcgccgtaggaggacgccggcgagtgggcgcgcatcggatccgggtcgtacggcgtcgaattcgcctgcgccagcagccgggcgcgaacctgcggggatccgtgctcccactggctgcgcagatcgggtcggccccagccgaccgagaacagctcgtacatggtggggaacggagtcatgctggacgggtcgtgatggccggccgtggccagcgcctcctcgatggcgtgcgtgcccagcttgtcgatcagcaggtcggtcgccatgttgtcactggtggcgatcatcttctcggcggcggtgcgcaccgagacctgcgccccggcgggcagcgccagacccgacgaacccacggcccggctcttgtcggtgacggtcagctggtcgtcccaggacacccttccggcggtgaccgcgccggccagggcgtgcagcacgtagagcttgaaaatcgatgccagcggcagggcttcgccggtgttggtgcccgccaccggttcgcagcggccctgcgggtcgaccttggcggcctgatacgagtagcgcgcgccggtcttgctcaacaccgcatcgacgtcatgccacgagttgaccgtgggcgcccgggtgtccaggtcgaagcggtccacccagccgccgtcgtcggtgtggatccggatgtcttggcgggcaccgtaggacgacgtcaggtgcagggtggccacgctggccccgatgtcgacaccgttgagggtgaacgggcggtcccaccacagcgcctccagcgtggtctgcaccgactccaccttgtcggcggcggccagggtgcgaacgccgaccggtccgatgggccagtccgaattcagcatgtccaacgtctgctgggcccggatgccgggcggcgtccgggtgtcgatctggcgtcccggattggccgcgttcgcctgcggggagggggaggaggcgcacccgggcgccaaggtcgccaccagtgcggcggcagcgctcagcgccagtgcgcggcgccaggcgaacagcccgctagccagcctgcttgtttgcggcaacgtccagcacaacctcgaattccagcagagacgccccggtcgccaccgggttggcccgatggccggcgtgcgcttcgatggcgggacccttcgcccacgcctggaacgcctcgtcggactcccagtgtgtcaccacgaagtagcggtcctcgccctggaccggacgcagcaactggaagccgaggaagccgggctgattctccaccgcatgggcgcggtgggcgaaccgcttctccagttccgggcccgcgtcggcgggcacttcgattgcgttgatcttcaccactggcggcatgccgctaggctaccccggcccccgcccgggacaaccggcgcggtgcacgcaagatggtggcatgcccagcacggtgttgactcgccacggcggccacggcgagcccctggtgctggtgcacggcctgatgggccggggcagcacctggacgcgccagctgccgtggctgacccggctgggcaccgtctacagctacgacgcgccctggcaccgcggccgcgacgtcgacgacccgcacccgatcagcaccgaacgcttcgtggccgacctggccgacgcggtgggcaccctggatgcgccggcccggatggtcgggcattcgatgggcgccctgcactcgtggtgcctggccgcgcagcatcccgagctggtgtcggccctggtggtcgaggacatggccccggatttccgcggccgcaccaccggcccgtgggagccgtggctgcacgccctgccggtcgaattcgattccgccgaacaggtattcgccgaattcgggccggtcgccgggcagtacttcctggaggcgttcgaccgcaccgaaaccggttggcggctgcacggccacacctcgcgatggatcgagatcgccgcggaatggggcaggcgcgattactgggcgcagtggcgcgcggtgcgcgtcccggcgctgctgatcgaggccggcaattccgtcaccccgcccggccagatgctcgagatggccgaaagggccttcgccgcaacctatttgcacgtcccacaggccgggcacctggtccacgacgaggcgccgaaggcgtaccggcaggccgtcgagtcattcctcgccggctagggcgaaccggccgtcggtggtctgcgtcaccaggccgtcggccagcagcgaatacagcgcccggtcccgctgcgctgtgtcggtcagccaggccacgtccagctcggcccgggtgaccggagaatcgttgccgcgcaacacatccagcaggcgtccgcgcacctgccggtcggttccggcgtaggtctgaacccgccgcgccggcccggtcgccgggggatgaccggcctcgcgccaggcgcaccggcgcagcgggcacaacccgcagcgcggggcgcgggcggtgcacaccgtggcccccagctccatcagcgcgaccgagaactccggcgcgctgccgtcgcccggcagcagcgccgccacgtcggcgtggtcgcggccggcggacggcgccccggcgtcggcctggccgtgcaccgcgcgggccaccacccggcgcacgttggtgtccaccaccggcaccgggcgtcggtaggcgaagcaggcgacggcgcgggcggtgtagccgccgacccccggcagcgtcagcagggtgtcgacgtcgtcgggaacgacgtcgccgtgatcgcgcgcgatcacggtggcgcactcgtgtaatcgcttggcgcgccgcggatatcccagcttgccccaggcgcgcagcacgtcggcggcgctggccgccgcggtggccgacggggtgggccagcgccgcacccagtccggccagatcggcagcacccgcgacaccggcgtctgctgcagcatgaactcgctgaccaggatctgccatgcgctgacgccgggggcgcgccacggcagatcgcggcgcgcaacccgataccactcgagaagatcggtaaccgatatgagtgggctgccgtcggccggcggctgcggcatgatgtcagccatgcctaacaccagtccggtaaccgcgtggaagtcactcaaagagggtaacgagcgattcgtcgccgggaagccgcagcatccgagccaaagcgtcgagcatcgcgccagcctggccgccgggcagagccccactgcggtggtgttcggctgctcggacagccgggtcgccgccgagctgatcttcgaccagggcctgggcgacatgttcgtggtgcgcaccgcgggccaggccatcgacaccgcggtcctgggttccatcgaattcgcggtgagcgtgctcaacgtgccgctgatcgtggtgttgggccatgacagctgcggcgcggtcaaggccgccctgggcgccatcgaggagggcgccatccccggcggtttcgtccgcgacgtggtggagcgggtggcgccgtcgatcctgatgggccgccgcgagggcctgagccgcgtcgacgagttcgaggagcggcacgtccgcgaaaccgtggcccagctggtgtcgcggtccacgaccatcgccgagcgaatcggcgacggcacggtcgcggtggccggcgtcacctaccacctggccgacgggcgggcggccctgtgcgaccacgtgggcgacatcggcgaataacgggcgagcggcccgccgatcccgcccgagcggccgggtcggcgggccacccttacaccggggtcagccagcaaacctcgcgacacgccggggcgggtcagccgaatcggcgtgacctgggcctacgctgcgaacgtgctcgatctggaaccgcgtggcccgctacccaccgagatctactggcggcgcagaggcctggccgtgggcatcgcggtcgtcgtgatcggggtcgtggccgccgcggtcatcgccttcatgggacacagcgcgggagccaagcccgccaacgccgacaagccgaactccgcgcagagcaagccgggatcaccggcgccgcaggcgccggcgccccccggcccggagggccccgccccggcggtgccgccggcgcagggccagaaccccgagacgcccacacccaccgccgccgtgcagccgccgccggtgctcaaggagggcgacgactgccccgactcgacgctggcggtcaaggggctgaccaacgcgccgcaatacttcatcggtgaccagccgaagttcaccatggtcgtcaccaacatcgggctggtggcctgcaagcgcgacgtgggcgccgcggtgctggcagcctacgtctactcgctggacaataagcggctgtggtcgaacctggactgcgcgccgtccaacgagacgctgatcaagaccttcaccccgggcgagcaggtgaccaccgcggtgacctggacgggcatgggctcggcgccgcactgcccgctgccgcggccggcgatcgggcccggcacctacaacctcgtcgtgcagctgggcaatctgcgctcgcagccggttccgttcatcatgaaccagccgccaccgccgcccggcccggtgcccggaccaggtcagcccggggcggtgccgcagcccgaggcgccgccggtgcccccgccgccggccggctgaagcaccggcgactcagctcaacgcgactcagctcagcgagtcggtgatcgtcgactccgccagctgcgaaagtccttctcgcacatggcgggcccacatcgcgccgatgccgtcgatcgactgcaggtcgctggcgctggccgccagcacgttctgcagcgtcccgaatgatcggaccaacaggtcggcgtgagcgaactgcagccggggtatgccggccagcgcccggtagccgcgcgggctgaccgccgagtcctgcgcctccgtcgtcgtcggatagccgaaaacctttgccagcgcggtgaaatcgagcagctcggtgtccgagagcgcatccagctcgtcgagggtggcggtcatctgggcctcggacagctgctcggggctggcgtggtagtcacgcacgatcaactcgcgggcgttgtcgttgccgcccagcagctcgtcgagctgcagccgcagctgccggccgtcggtgccgagctcgaccacgtcgttgtcgatcacctggccgatccgccgcaccagctccaggcgctgcaccacggtcaggacgtcgcgcagcgtgacgaagtcctcgatctcggcgcgcgacagctgcctgctgacctcgtccagccggatcttgtaccgctccagggtggcgatggcctgattggcccgcgacagaatggtcgccgaatccgccaccacgtgccgctccccgcccacgtagacggtcacgatgttcatcgaatggctcaccgagatcaccggatagccggtctggatcgcggcccgctccgccgagcggtgccgggtccccgactcgtcggtggcgatcgaggggtcggggaccagctgcacgttggcccgcacgatgcggctgccgtcggtggacagcaccacggcgccgtccatcttcgccagctcgcgcagccgggtcggcgcgtagcgcacatccagcgcgaagccgccgtcgcagatggcctcgacgttttcgtcgttgccgagcacgatcagcgcgccggtgcggccgcgcaggatgcgctccaggccgtcacgcagcccggtgcccggggccagccgggcgacggtctcacgcagcgtcggacgagtcacagcgtgtcattctgcggccccagtgcacgatgcgtccagcctttgcggggctcggcgatgtcgaccatgtgcttcagcgccgcaccgatggtcggggcccgcagcgcccgcatcccgctgggcacgatctcgcgccgcgggtcgtcgccgtccgggatcagcgcgatggaaaacccctgccgggcggcctcgctcagccgccgcgccatgccactgacccgccgcaggtccccggccagccccacctcgccgatcatcaccgccgtcgtcggcagcggcagctcggacagcgccgacgccagcgcgatcgcgacggccagatccgacgacgggtcggtcagccgcatgccgccgaccgtggacaggtagatgtcgttgaccgcgaccggcagctttccgtgcttttccagcaccgcggtgatcatcgcggcccgggagtggtcgatgccgctcaccgcgcggcgcggggagccgcccgacgggctggccagcaacgcctgcacctcgccgatcagcggccgtttgccgtccagcgtcaccgtgatcgcggtgcccggcaccggggccgagcgctgatccagaaacaggttcgacggatcggtgacgccggcgatcccgttgtcgtgcaacagaaaacacccgacctcgtcggcggcgccgaaccggttcttgatgccgcggaccatccgcagcgagccgttgcggtcgccctcgaagtgcagcaccacgtcgaccaggtgctcgagcgaccgcggcccggcgatggcgccgtccttggtgacgtgcccgaccaggatcagcgccaccccgttggccttggccgcggcggtcagcgccgccgtcaccgcccgcacctgcgtgactccgccggcgacgccgtcggcctcggtggtggacatggtctgcaccgaatccacgatcaccagcgcgggcttgacggtggcgatgtgctcgagcaccgtgtgcaggtcggattccgcggccagatacacctggtccccgccgcagccgatgcggtcggcccgcagccggatctggccggccgactcctcaccggagatgtacagcgcgcgccggccggactgcgcccagcggtgcgcgacctcgagcagcagcgtcgacttgcccacgcccggatcgccggccagcagcgtgaccgaaccaggcaccacgccgccgccgagcacccggtcgagctcgtccacaccggtcgagcggtgccggctggcgtcgggcttgatggaggtgatcggcacggcctgcgacgcggccgtcaggcgcgggcgacggccggccaccgcgctgagcgcgggaacctcgtcgacggtgccccaggtgccgcattccaggcagcggccgacccacttcgccgtgacgtgccggcattccgagcagcggtattgggagcgtgcggttgccacgtgatgacggtagcgagcggctacgacaagaccgcgccgcgacaggcggtcagccggcgtgatcgggctgcggcgccaccccggccgagatcgggaccagcacgctcgcctgcccggccttctcgaacgagaaggtgaagttgtaggtcaggccgttggtgatcggcttggccagcgtgaccgtcgccttggccgcggtgttggagccgatcgggccgggcgccaccttctggccctccggcgtgccgatgaacagcatcccgccggccggcagccgggtgtcgccgctcagcgtcaccgtgccgatgtcggtggtgatgcccaccagcttgtccggggtgttcggggactggttgacggccaccgccaccaggtccacagcccggcccggctgcaggaagtcgccggtctgcacggcctggatccggatgtcgcgcaacgccacgttgttgaaggtgaccttgttgccgttgatggcgggttcctgcaccgccatctgcgagacctgaccggccccgcaaccgctgagcaggacggccggcacggccaccgccccggcgagggcgacccggacggcgcgcgcgggaaggccgaggcggatcttgaagcggttcactctctcgagcctcctgctgagccgtgcgactgaatgcaactatgcacagtagtaggaacgtcttcggcgcggtagcgcggggcgccagaccagcgcgggagcgctcgcacaggccgcttccggggccgacggcgggcattggtaatgtgctgcactgcacgacttgctcctcatgtcaacccctaatctgcgcgtgttgtgcccctgacctgcatcgttgcttcgcgcgtggttaggcggacgtgttaggatgaagtaacgaaaggggctcgaatcagatgatcttcaaggtcggcgacaccgttgtgtacccacatcacggtgctgcgttagtcgaggcgatcgaaacccggacgatcaaaggggaacaaaaagagtatctcgtcttgaaggtggcgcagggcgacctgaccgttcgagttcccgccgagaacgccgaatacgtcggcgtgcgcgacgtcgtcggacaagaaggcctcgacaaggtattccaggtgctgcgcgccccgcacaccgaggagccgaccaactggtcgcgccgctacaaggccaacctggagaagctcgcctccggtgacgtcaacaaggtcgccgaggtggtgcgcgacctgtggcgccgcgaccaggagcgcggcctgtcggccggcgagaagcgcatgctggccaaggcccgccagatcctggtcggtgaactggcgctggccgagagcaccgacgacgccaaggccgagaccatcctcgacgaggttctggccgccgcttcctgaaggtcctgacacttcattggtcccggagacggggttggccccggagacgggcagctcaggcaccgtagccgccgtcgtcccggccgccgggtcgggggagcgactggcagcgggaattcccaaggcattctgcgagatcgacggcgccagcatgctggcccgcgccgtcgccggtctgctggactccaaggtggtcgaccacgtggtggtggcggtacccgccgaccgcgtcgacgaggccaaacgactgctgcccgggcaggccaccgtcgtcgccggcggagccgaccgcaccgcatccgtgcgcctggccctggccgccgtccccggcaaccccgcgttcgtgctggtccacgacgccgcccgcgccctgacgccgccggcgctgatcgcccgggtggtgcaggcgctgcgcgacggtcaccgcgccgtggtgccggcgctgccgctgcacgacaccgtcaaggccgtggacgccaacggggtggtgctcggcacgccggaacgcgacgggctgcgggcggtgcagacaccgcagggtttcgccaccgacctgctgctgcgcgcctacgccgccggggccggcacggcgggtttcaccgacgacgcgtcgctggtcgagcacgtcggcggccaggtccaggtggtcgacggcgacccgctggccttcaagatcaccacccagctcgatctgctgctggccgagaccatcgtgcgccggtgaacaccaccccgcggatcggcctgggcgtcgacgtgcacccgatccagcccgggcggccgtgccggctgctgggcctgcttttcgacgacgccgacggctgcgccggccactccgacggcgacgtgggcgcgcacgcgctgtgcgacgccgtgttgtcggcggcgggcctgggcgacgtgggtgcggtgttcggcgtcgacgatccgcgctgggcgggtgtcagcggcgccgacatgctgcgccacgtcgccgatctgacggcgcgccacggctttcgggtgggcaacgccgccgtccaggtgatcgggaaccggcccaaggtcgggccgcgccgcgccgaggcgcagcgggtgctgtcggagctgctgggggcgccggtgtcggtggcggcgacgacgaccgacgggctcgggctgaccgggcgcggtgagggcctggccgccatcgccaccgcgctggtggtccccaccggctgagcccgcgcggcgcggacgccgcggaaccacccggtaagctggcacgtcgtgaccgatcgcccccgcttgcggctacacgacacggcagccggtgctgtgcgtgatttcgtaccgctgcgcgacggccacgtctccatctacctctgcggcgccaccgtgcagggcctgccgcacatcggccacgtccgcagcggggtggccttcgacatcctgcgccgctggctgatcgccctcggctacgacgtcgccttcatccgcaacgtcaccgacatcgacgacaagatcctcaacaaggccgccgcggcgggccggccgtggtgggagtgggcggccacctacgaacgcgcgttcagcgccgcctacgacgccctggacgtgttgccgccgtcggccgagccgcgcgccaccgggcacatcacccagatggtcgaattgatcgagcggctgatcgaaaagggccacgcctacaccggcgacggcgacgtctacttcgacgtgctcagctaccccgagtacgggcagctgtccgggcacaggatcgacgacgtccaccagggcgagggcgtggccagcggcaagcgtgaccaacgcgacttcacgctgtggaagggcgccaagcccggcgagccgtcctggcccacgccgtggggccgcgggcgcccgggctggcacaccgaatgcgtggccatggcccacgagtacctcggccccgaattcgacatccattgcggcggaatggatttggtgttcccccaccacgagaacgagatcgcccagagccgcgcggccggggacgggttcgcccgctactggctgcacaacggctgggtgaccatgggcggggagaagatgagcaagtcgctgggcaacgtgctggccatcccggcgatgctgcagcgggtgcggcccgccgagctgcgctactacctgggcagcgcgcactaccggtcgatgctggagttctccgacaccgcgctgcaggacgccgtgaaagcctatgtgggagttgaggaattcctgcaccgggtgcgggtgcgagtcggcgcggtggagccgggcgagcccaacccgcggttcgccgacgcgctcaacgacgacctggcggtgccggccgcgctggccgaggtgcaccaggcccgcgccgaaggcaaccgcgccctggacagcggcgatcacgagggcgcgctgcggcaggcccgctccatccgcgcgatgatgggcatcctgggctgcgacccgctgcacgaacgctgggagacccgcgacgagacatcggcggccctggccgccgtcgacgtgctggtgcgcgcggagctgcagaatcgggagaaggcgcgcgagcagcgcaactgggcgctcgccgacgagatccgaaaccggctcaagcaggccggcatcgaggtcaccgacaccgccgacgggccgcagtggacgttgggcggagacggcaagtagatggcgggcaactcgcgacgccgcggcgcggtacgcaaagccggcaccaagaagggcccgaccgtgggttcagggggccagcgtcgccgcgggctggagggccgcggtcccacgccgcccgcgcacctgcggcccaaccaccccgccgccaagcgcgcccaatcgccgccccgccgccccgccaagcgcaccgaggagaccgagacggtgctgggccgcaacccggtgctggaatgcctgcgcgccggcgtcccggcgaccgcgctgtatgtggcgttgggcaccgaggccgacgaacggctcaccgaatccgtctcccgcgcagccgattcgggcatctcgatcctcgaggtgccgcgcgcggacctggaccggatgaccgggaaccacctgcatcagggcatcgcgttgcaggtgccgccgtatatctacgcccaccccgacgacctgctcgaggccgcggccggttcgctgccggcactgctggtcgcgctggacaacatctccgacccgcgcaacctgggcgccatcgtccggtcggtcgccgcgttcggcggccacggtgtgctgatcccgcagcggcggtcggcgtcggtgacggcggtggcctggcgcaccagcgccggggccgccgcccgcatcccggtcgcgcgggccaccaatctcacccgcacactgcaggattgggccgaccgcgggctgcgggtgatcgggctggacgccggcggggacaccatgctcgacgacctggatggcagcgacccgctggtggtcgtcgtgggctcggagggcaaggggctgtcccggctggtgcggcagaactgtgacgaggtggtgtccatcccgatggccggcagcgccgaatcgctgaacgcctcggtggccgcgggggtggtgctggccgagatctcccggcagcgcaggggttgagttccctgggctcgcggtgggcggcggcggtggcgctgctgatggcggtgctgctgtcggcggcgccggtgtatgggcagccggcgacctttgatctgcaggcccatcgcggcggccgcggcgagacgacggaggagtcgctgcgcgccttcgccaaggcgatccaaaccggcgtcagcacactggaactcgacatcgtcgtgacccgcgacggccaaccgctggtgtggcacgacccgacgatccaggccgacaaatgcagcgacaccggcccggcgttccccggcgacccgggctacccgtatgtcggcaagctggtgcaccagctcaccgtcgcgcagatccacaccctggacggcgggcaccggctgaaagagttcccggacgcggaagtggtgcgcggcaacaagatcgcgacccttcctgaggtcttcgcggtggccgactcgcaccgcgccgacgcgatccgctacaacatcgaaaccaaggtggagcccgacgacaccggcgcgtcggcgcagccccaggagttcgtcgacgtgatcctggccgcggtcaggtcggcggacaagctcgcgcgggtggagatccagagcttcgactggcgcaccctgccgctggtacggcgggccgagccgtccatcccgctggtggccctgtacgacgagcgggccgccggtgacccggtgctcggggcgcgggcggccggtgccgacatcgtctccccggactaccggctggtcaccggcaaaccgtacgtcgaccgcgcgcatgcgttggggctcaaggtcattccgtggaccgtcgatgacgccgaggacatgcggcgccagatcgactacggcgtcgacgggctcatcaccgacttcccgacgttggcgcgcggggtgctggccgaactcggcgtgccgctgccgccggccgtgccggggtgatcggcgccgcgggcgcgcgcggcgcgccacatgatgctcggccgcaacagccgggtcgcggggtcgacgagcgaggtgaccctgatgaactggttcagcgcgaccgtgtcggtttcggccgcggtgagcacccgatcgacgtacttgttgaacgcccgggctatcagcggcggggtgccctcgatttcgggcagggcgaggtcggggttggtggacagctgccaggcctgccggatcggcgccgccgcggcgcggaagaatcggcgcgcgagatccgttgtgccgcttgacaagcagtcgcgcagcgccagtgcctccagcgcggccaccgacatgccctggccgtagatcgggttgaagctgcagatcgcgtcgccggtgaccagcaggccgtccggaaaacgccgcagcttgtcgtagcggcgccagcggctgcacggcatccggtgccgcaccggctccccgacgggttcggcgccgcgcaccgcggcgagcaggtgcgccggtgcgcagtcggcgatgaaatcgcacatggtggcgaggtccagcgtcgcgggctcctcgccgccgacccccatcacggtgagcagccaggtgtcgtgctcgcagtgcagcagcccgcagccgcgcggcctgcccggcacgatcccgatcagcaagccgagttcgcgcggcgcctcgcccgtcatgcgcaacgcctggctggcgtaggtgagctgcacggtgacgcggtcctcgcgcgggcggtcataccccaggccgtccagccaggtgggcgtgtgggcggcgcgcccggtggcgtcgaccaccaaatcggcgggcatcgcggtggtttcgccggtccggccgtcggccacccacgcccccaccacgcgccggcggtcggcggtcgagacgagacgcgtgacgcagtgctcgtcgcgcagggtgacgttgggaatgccgcgcagccgcccgcggacgtggtcctcgaggaacggccgggtcgcgctgtaggcggtcagtccgggggcggcgccgctgcgcgtcatcagatgcccgccgatgttgtagtagagctgcgagaggtcctggccgtcgaagtactgggcgccgtcgcggaccatctggtcgagaacacccgggaacaactcctcgatcgcctgggcgccgcggcacaacagggcgtgcagatgccggccctgcggcacaccccgccgagcgccgtgggcgtcgggcagcgggtcgcgctccaccacggtgacccggtcgaagaagtcggccagcgagcgcgcggccagcaaaccgcccatgctcgcccccaacaccaccgcgtgctcacccaccttggtcgtcatgtcgccgcctttccgagctgttagctgacaaaaacaatgctcacgggcaccggcgggcgccgatagcgtagtcgggtactccacctcgggtggccgcgccgccgccggtcccgcggccgcgctaccgaaggcgggcaatcccgcccgcgcggccccccgcacggctatgctcgccgcgtgatcggcggcgagctgctgattgggcgcgacagcgaattggccgccattcgccgcgccctgaacggggctgaccaccaccgcggagtggtgatcgccggggccgccggcgtgggcaagacctggctggcccgtgcggcgctgcggcgcgccggggcgtcgggcgagcagatcaaatggatcgtcggcacccagtccgcccaggccctgccgctcggggcgttcatcggcctgctcggcgacgcgatgtcggagccgctcaccagcgtgcggcgggtgatcgagacgttcgtggcccggcaacgccggggccgggtggtggtgggcgtcgacgacgcgcacctgctggacgggttgtcggccctggtggtgcaccagctggcgcagtccggtggggtccggctggtggtgacggtgcgcaccggcagccaccagcccgacgccgtgacggcgctgtggaaggacgacctgctgactcgccttgatctggaaccactttcggccgcggcgacccgcgaggtgatcgagagcacgctgggtggcccggtcgatgcgcggtgcgcggcgcggttccggcggctcaccgggggcaacacgctgtttttgcggcagctgctgagcgaccagatggccgccgggcggatgcgccgcgtggccggggtgtggatgtgggacggcgacgtcgccgtctcggccagcctgtccgacacggtgggacgccagctgggccggctcaccccaccgctggcgctggtggtggacacattgtcgcagtgcgagccgctgccggtagacctgttgtgcgacttggcatctcgagaagacctggttgcggccgaggcgatgggactggtgaccgtcgaacgcaccccgcgcgccttgatggcccggctcgcgcacccgctgttcggtgagctccgccgggccggcgccggcgagatgtacctgtcgacgatccggggccggctggcgacccggctggcgcaggaccaagacgccgacatgcaggccacggtgcgccgggcgttgctgaccctggagtccgacctggacccgcaacccgagctgtacctggagtcggcgcggcacgcgatgacgctgttggacctggacctggccgaccggctggccaacgccgccgcgcgggccggggcgcccggcgccgccggggtgcgggcgatgaacctggtgctgctcggccggggcgagcaggccgaggaggcgttgcgggccatcaccgacggcgccgacggcgacgcgtccgatcggcactattgggcgacggtgcgcgcggccaacctggtgtggatgctgggccggccggccgatgccgcgctgatcctcgacggcctcgccgcgcggcccgagaccccggcgcaggccgcggcgcgttgcgcggtgcaggcctgcctggacgcggtggccgcgcgctgtcagctcgccgccgaacgagccagggccgattggattccgagtcgctgccggatttccatgcgatgatggcgtcgctggcgctgatcatggcgatgggggcgctgggacaggtcgacgacctgaccgcggtggccgagcaggcgctgcgccgcgcgacgacgtcgttcgaggcgtcacacatgcggttctggttcggcgccgtgtacgggcgggcgtgccggctgaccggacgcatcgacgaattcgtcagcaccgcaagacgattggccgactcggcccgtgacgtccccggtttggcgtacgcgaacctggccctgttgctgggcaacgccgagctggcccgcggggccgcggccgaggcggcccggctggtgcaggaagcgctcgccggtgcgcagatacacgaagtcaccagcggtttgcggccggccagctatttcgcgttggccgaggcgcacggcaggctcgggcacccggcgcaagccaacgaggcgatcgccggggcgagatcctgcgtgccgccggacttcctgttcatgcacaccggtctggcgctggccaccggctgggcgctggccgccggcggccagctgcgcgaggccgtcgccaccgcgcaggcggcggcgcggctcgcccgcgaccgcggccagcccacccacgaactggcctgcatccaagccgcggcgcaatggggggacgccgcgggggcggcgcgcgcccgcgcgctggccgacgcgctgtcgctgccgctggccgacgccatcgcctgccacgccgaggcgctgcgggccggcaacggcgaggccctgctgacggtcgcggcggcctaccgggcgatcggcgacgcggccgccgccgccgacgcggccgcgcaggcctccgccgcgttcgtcgaggggcagcagcaccagcgcgggcggtatgcggcggccctggccggtgagctggccgaggaatgcggcggcctgtgcacgccggcgttgcggaccccggcggggctcaagctatcgggccggcagcgcgacgtcatcgaactcgccgtcgccggcctgtccaaccgccagatcgccgagcggttggtgatgtcggtgcgcaccgtggagggccatatctaccgggcctgccaacgggtgggcgcccagtcgcgcgacgaactggccaccatcatccgcaccaggccggccggccgcgaaagctagccgcccagcagccgcgccgacgcccacagcgccagcacggccaccagcagcgagaccggcacggtgcacacgccgaggcgggtgtattcgcccaccccggcgtccacgccgtgttgacgtaacaccctgcgccacaacaggttcgacagcgaaccgacataggtcaggttggggccgatgttcaccccgatcaacaccgccagcaccgccaccggcccggccggcgcgaccagcggcagcagcaccagcgtggccggcaggttgttgacgacgttggccagcaccgcggccgtcgcggcgatcgcgagcagggcgggcaggcccgagcccgacggcagcaccgccgacatcgcccggtccatcccgttgcgcatgacggcctgcaccaccacacccagcgccaggacgaaaaccaggaacgacacgtggaccgagcgcgcgatctccgtcaccgtggtgtgcccgcgggccagactgcgcaccgccagcaccgacgcgccgcacagcgccacccacgccggggcgatccccaccgactgggcgaccgcgaacccggcgagcgtcagcgcgaccaccaccaacacgaacaccggcgggcgcggcggcgcgccgagcgccgccgggtcgggctgcacccgcaggtccttggcgaagaacccgcggaagacggcgtagagggtggccaccgcggccagccacggcgccgccatcaacagcgtgaacctggtgaacgacagctgggccgtgtggaaggccagcaggttggtcaggttggacaccggcagcaacagcgaggcgccgttggccaggtgggcggtggcataggcgtacggccgcaccgcggtgcgctgccggcgcaccgcggccagcaccaccggggtcagcaacaccacggcggcgtccaggctcagcaccgcggtgatggccgaggcgatgacgaacacccgccgcagcatgccggccgacccgacgcggcccctcgcgatcgccgcacccgccgcctcgaacaggccctcgtcgtcgcacagcttggccagcaccagcaccgcgcccaggaaggcgaccaccccggacaggtcggcgatctgctgttcggccgcggcgaccgggatcgcgccgacacccaccagcagcagcgccgccggcaccgccgccaccgcctccggccaaccccgcgggcgcgcgacggcgaacccgagcaccaccgcaagcagcaccagcgcaacggtcaatgccatcgaaaacgctttacgcccaagggtcttcgcgtcgccacacgctcggcaggtgcagcgcgacaccgtcgcgctcggcgagctcgtccaggacgcggatggaggagtccaggtcatcgcccgcataaggcaacgcccgcaacggttttgacagcggacggaagaagtcgtcccaatggatcaggatcacccggcgcgccccgaccgtgcgcacggtctggtcccaatactcgtccaggtacgaccgcggccgcagccccagctgcccgacggacagataggccgcctcggcgcgctgcccggccagcgcgccggccacgaatccggcgctgccgcagatcagcagccggcgccccgtcggccggtgccgcaccagtgtcgaccaggactcgccgcagcggtacgccgacgcccgcgccggcgggatcagcggctcctcgatcacgccggggaaccggtcgggcgggcagtggtgggacttgaccagcgttacgtcgaaggcgcccaaccggattggctcgccgtcggccgcgacgacgatgcggtcctcgggcagcccgtagccgcgtccgacattggccgcggactctccgccgaccagcagcgcgccggtgcggtcggccaccagcgcggagtccagcgtgtggtcgaagtgggtgtgcaccgggatgacggcctccagccgggacaccttggcccgggccaggcagccgtcgacgcgcggcggcgacggcgacaccttgccggcgaccacccgggccaggccgggccgggagaagtagccgtcggtcagcagcgccgacgagccgtcgtcgatcagcaggctcgccacccccagccaggtcaccgacagcccaccggggccggccgcgggcacgtcgaacctgtcggcgtagcgggtgatgtcggggcgaccgagcctgagccgcatcagcagaacgcccggatctcgacgccggccgcccgcaggcgatcgcgcaccgcggtggcgatctgcaccgcccccggcgaatcaccgtgcacgcaaaccgattccacgctcagctcgagccgggtgccgttgacggcggtgaccgccccggtgtcgaccatggccagcacccgctcggcgatggccgccgggtctgccagcaccgcgcccggttcccggcgggagaccagccggccgtccggccggtaggcccgatcggcgaacgcctcggcgaccacccgcagaccgcggcgggcggcctcgtcgaaaaacaccgagccagccatgcccagcaccggcagcccggggtccaccagccggaccgcctcggccacggcggcggcctgcgcggggtgcgtcacgatcgtgttgtacagcgcgccatgcggtttgacgtagcacacggaagaacccgccgcgtgcgcgatcgcctgcagcgcgccgatctggtacaccacgtcggcgagcagctcgtcggcggcgacgtcgatgaaacgccggccgaacccggccaggtcgcggtagctgacctgcgcgccgactcgcaccccgcgctcggcggccgaccggcacacccgcagcagcccggcggggtcgccggcgtggaaaccgcacgccacgttggcgctgctgacgatgccgagcatggcgtcgtcgtcaccgaggcgccagacgccgaagccctcgcccaggtcggcgttgaggtcgataccggccacccgcccagcttaggtggcggcctcccggcggcgcccgatcagccagcaggccagatagatcaggaacgagatggtcgcgacgaacaccgacaccggcacgcccggcgccagcgacagcacgatcccgcccagcgccgacacctcggcgaaggccaccgaggccagcatcgcggccccgggcgaggcgaccacccgggccgccgcggccgccggggtgatcagcagcgacatcaccagcagcgcgccgacgatctgcaccgcctgggccgccaccacaccgaccagcgccgcgaacacgatgcccagcgcgtgcaccggcaccccgcgcgcggcggcgacgtcggggtcgacggtggcgaacaacagcgggcggtaacacgtcgccaacacggcgatcaccagcaggcacaccagcgccagcatggtcagcccggtgtagccgaccccgacgatctggccggtcagcaacgcgaaactggtcgcggtgcgacccgggtagaggtggatgaacagcaccgccagccccaacccgaacgccagcaccacaccgatcaccgagtcgcgttcccgggcgcgccggcccagcaccccgaacagcgcggccgccagcgcgctgccgatcagcgcgcccaccccgacgccgatcccgaccagcagcgcgaatgcggccccggtcagcgacaattcgctggagccgtgcaccgcgaacgacatctgccgcatcacgatgaacggcccgatcagcccggccaccaaacccagcagggccgccgcgaccagcgcctgctgcacgaagtcgtggcccagcaggtgcaccgtgatgtccaaggagaacaggtggtcggccatgtcggcgaggcgatgctccatcagccgtgcccgtcggtgtgctcgccggccaccacgtagccgcccttgaccttcaccacctggatgtcggcccggtacagcgccgagagcgtctcgctgttcatcacctgctcgacggtgccgatccggaaccggccgtcgaccagatacagcacccggtccacgtacggcaggatcgggttgatctcgtgggtgacgacgatgaccgtggtcgcggcgtcccggcggcgacgctccagcagcgccgacaccagcttggcgttggcggggtccagggtcagcagcggctcgtcgcacagcagcagcagcgggtcgctgaccagggcctgggcgacgcgcatccgctgcagctcgccgcccgacatcaccccgacccgcacgtccgccaggagttcgccgttgacctggcgcagcgcctggtccaccgtggcgcggcggcgcgcccgctcccggggccgcagcggcgcggcgccccagcgcccgccgtccaggccgagccggaccaggtcgcgtccgcgcagcatcacgtcgcgctccatcgggcggtgttgcggtacgtagccgatgcgcccgctgcccgaggtgatcggcttcccgtccaccagccccaccccggcgctcagcggcagctggcccagcagcaccttcagcagcgacgtcttgccgctgccgttcgggccgagcaccgcgacgaactcgccccgcgacaccgacaggtccaggtcctcccacagcacccggtcgccgaacgcgagccgggcgccgcgcagcgagacggtgtcggcgtcgtggtcgacggccgcggcggcctgcaggctcacggctgcaacgaccgtacgggttgcagcgccgtctgcagctggcccaccgtattgcgttgccagctcaggtaatccgcgccgtcgggcaatgtctcgcggacctcgacgaccgggacgccggcgcgccgggcggcctcgcgcaggccgttgaccgcggacgccgacgtctgcgggttgaccaccagcgccgacacctggtgccggtcgagcaggtcgagggcccgcgccaggtcggcgggcgcggggtcggtctcgttctcgacggccgcttccagcgccggcggcgtccggttcaccaggcccgacgcctcgagcaggtagaaggcgaccggctcggtggcgacgaccgagccgccggggtgggcggccgcgatggtgtgctcgatgccggcgatggcgtcggcgtcgcggccgaacgcggccgcattgcgtcggtagtccgcggcgttgcccgggtcgatcgccgccagccggtcggcgacggcggcggccaccgccttggcgacgcccaggtggtagaacacgtgctcgtttcgggggcggccgtcgtcgggcagcaacgcgtaggcgtcgacccgcgcgacgccgggatgatgcgccagcacgtcgtcgacccagccgtcgtagccgccgccgttgaagacgaccaggccggcgtcggcgatcgcggcggcatccgacgggctggcctcataggagtgcgggtcttggtcggacccgctcaggatggacgcgaccgccacgtggccgccggccaccgcccgcgccacgctgccccacacgtcggtggacgcgacgacggcggtcgcgtgcggatgcgccggaccggtgcacccggtcagcgccgcccagccggtcaccgccagcacggccgccagccaccgcgtcgtgcggccgacccgcgttgcgtcccgcgtcagtgccgtgcccacgtccgatgtcctcccgccggccagccagccgatgcacaatactaatgaaaatcgtttccattacaaagccggccggggaagcgcgtacgcgagcgcaccgatccgctgtagcgtcaccgagcgtgagtcccaccccgcgccggcgggcgactctggcgtcgctggccgacgaactcaaggtctcgcgcacgacggtgtcgaacgccttcaaccggcccgatcagctgtccgcggacctgcgtgagcgggtgctcgcgacggccaagcggctgggctaccccggccccgacccggtggcgcggtcgttgcggacccgcaaggccggcgcggtcggtctggtgatggccgaaccgctgacctacttcttcagcgaccccgccgcccgcgacttcgtcaccggggtggcgcagtcctgcgaggcgctggggcaggggctgctgctggtcgccgtcgggcccagccgcagcctggatgagggaaccgccgcggtgctgtcggccggggtggacggcttcgtggtgtattcggtgtgtgacgacgacccctacctgcaggccgtgttgcagcggcggctgccggtggtggtggtcgaccagcccaagggactgaccggggtgtcgcgggtgggcatcgacgaccgcgcggcgatgcgggagctcgccgactacgtgctcggcttggggcatcgcgagatcgggctgctgaccatgcggctgggccgggaccgccgccagggcctggtggacgccgaacggctgcgttcgcccgccttcgacgtgcagcgcgagcgcatcaccggggtgtgggaggcgatgacggccgccggcgtcgacccggattcgctgaccgtggtggagagctacgaacacctgcccgagtcgggcggcgcggccgccaaggtggcgctggaggccaacccgcggatcaccgcgctgatgtgcaccgccgacatcctggccctgtcggccatggattacctacgcgcccatggtgtttacgtgcccgggcagctgacggtgaccggattcgacggcgtgcccgacgcgatcagccggggcctgaccacggtgtcgcagtccagcctgcacaagggcagccgggccggtgagttgctgctcaagccggcacggtcgggcctgccggtggtcgagctgctcgacaccgagctgattcgcggccgtaccgccggtccgccggcctagccgtgctcgccgagcagcaaccgcaccgccagatcgaggcgcttgctgacgtcggtggccgaggcgcgccgggtcagccaggcgagcaggttggacagccacacgtcggagatcacccgggcgatgtggtactggtcctcggtgggttcgccgtcggccatcgcgcgggcgaacatcgagtcgatgagcttctccacctggtcgacctcgctggccgccgacgcgtcggcgaacacgtaggcccgcgtcatcgcctcggtcagcagcgggttgcgctgcatggcccggttgagcttgcccaccatgaagttcagccgctgaaacggggtgcccccggtcatcgccgcgcggtcggtcttggcgtcgatgcggctgaactcgcggcccagcgcggacaccagcaggtgcaccttcgacgggaaataccggtacagcgtgcccaccgcgacgtcggcgcgatcggccaccgcgcgcatctggaccgcctcgtagccgcccttggaggcgatcgccatggtggcgtccaggatgcgtttgcggcgttcccgctgcgcctccgagccgagttcggactccgccagtaccgccacgttcatgacctcgcgcggctgcgagtcggagacgcggctggaatcggccttcgactctgccttcgaagtggccctagctggcatgtggcggtgtgctcctgttccgggcggttcgtctgcaaacgatacgcattctgcgtgtgaatttcccacctccgtaccgccggggacaagcgcatgtgctgctgcgatggcgttcgacttgacggtcgatcactggcactattagaacacgttctagtctccggtgagcgagttgcgcgccaacacgtggcgcggatgtccccgctcgcggcgagatcggacaatcaggacacgggtgccgggcgcctggtcacgtcgagtcaaggacgcggaggtccccacggtggtagcgaccgtcaccgacgagcagttcgccgcgcgcgccctggtgcgcgactgggcccgcaacgccagcaccgggcccggcgggaccgccgccatccgcgacgtcgagcagggcaaccccgacgcctggcggccggtcttcgcccggctggccgagctcggcattttcggggtggcggttcccgaagaggccggcggggcgggcggcagcgtcgaggacctgtgcgccatggtcgaggaggcggccaaggcgctgatcccgggtccggtcgccaccaccgcgctggccaccctggtggtctcggatgccgagttgctggccgcgctggccgccggcgagcggttcgccgggctggcgctgcagggcgacatcaccttcgacggggcggcgtcgacggcctcgggcacgctgccgttcgcgctgggtgccgccgacggcggggtgctgctgctgccggccgacggcaggtggctggtggtcgacaccgcaagcgacggcgtgcacatcgagccgctggccgcgaccgacttctcccggccgctggcccgggtggtgctggactcggccccggccaccgtgctggcgcaaacccccgagcgggtcgaggagctggccgcgaccgtgctggcggccgaggccgccgggatcacccgctggtcgctgcagaccgccgtcgactacgccaaggtccgcgagcagttcggcaagccgatcggcagcttccaggcgataaaacacctctgcgccgaaatgctgtgccgcgccgagcaggccgaagtggccgccgccgacgccgcccgcgcggccgccgaggacgacccggcccagttctccctcgcggcggccctggccgcggccaccgccatcaccgcggtcaaggccaacgtcaaggactgcatccaggtgctcggcggcatcggctgcacctgggaacacgacgcccacctgtacctgcgccgtgcccacgccatcggccgcttcctgggcggggcggaacgctggctgcgccgtatcaccgcgctcacccaggcgggcgtgcgccgccggctgggtatcgacctgaccgaggtcgaggaccagcggccccagatcaccgaggccgtcgcccgcatcgccgcgctgcccgccgagcagcggcaggccgcgctggccgaggccgggctgcaggccccgcactggccggcgccgtacgggcgcggcgcctcgccggccgagcagctgctgatcgatcaggagctggccgccgccggggtggcccgtcccgacctggtgatcgggtggtgggcggcgccgaccattctcgagcacggcacacccgagcagatcgagcgcttcgtgcccggcaccttgcgcggcgaattcctttggtgccagctgttttccgagcccggcgccggctccgacctggcctcgctgcgcaccaaggcggtacgcaccgacggcggctggctgctgaccgggcagaaggtgtggacgtcggcggcgcacaaggcgcgctggggggtgtgtttggcccgcaccgatccggatgcgccgaaacacaagggcatcacctacttcctggtggacatgagcgccccgggcatcgagatccgcccgctgcgcgagatcaccggtgactcgctgttcaacgaggtcttcctggacaacgtgttcgtccccgacgagatggtggtcggcgaggtgaacgacggctggcggctggcccgcacgacgctggccaacgagcgggtcgcgatggccagcggcacggcgctgggcaacccgatggaggagctgctcgagctgctgtcgacgctgcccctcgacagcgctcagcaggatcggctggggcggttgatcgtcaccgcgcagaccggtgcgctgcttgaccagcggatcgcccagctcgccgtcggtggccaggaccccggcgcgcagtccagcgtgcgcaaactcatcggggtgcgctaccgccaggcgctggccgaatacacgatggatgtgtccgagggcggcggcctggtgcacaaccgcgcggtctacgacttcctgaacacccgctgtctgaccatcgccggcggcaccgagcagattctgctcaccgtcgccgcggagcggctgctgggtctgccgcgttaaccgagatcggctgcggcagcgtgtaattcgcgcagcgcctggcatgccatgtcgcccaggtcgccgctttcgtccggctcggcccagcgggcgtaggcggttttgaccgccagcgcgcccagctcggcggccaacgccgccgccggttcgggcacgccgcgtgcttgcagcgcctcggacaccgccagggccagcccgatctgcttgagcgcgttgcgctcctgcagctcggcgctggcggcgatcgcggccctgagccgcggcgcgagctccttgttgaacggcgtgaacgccgccgctgccgacttcaggccggagcacaccaaggctagcggtgtcgcgtcggcgggcgccgcggcgatgccctcgcgcagcagcgcggcgatggcgtcctggccggcggccagcacgtcccgcttgtccgggaagtgtctaaagaacgtgcttttcgtcaggccggcgcgctcggcgatctccgcgacggtcgtctggtcgtagccgcgctcgttgaacaggtccagcgccgcggcgaccaggcgtgcgcgcgcgtcgggttcccagcgagccatggccccaccttagtgatgcgacctttgtcccgtcactggtgtagggtgatgggaccattgtctcatcactcgaaggagcagctcgtgcgcgtactcgtcaccggcgccagcggaggaatcggctcggccgtcgtcaaagaattgctcgccgccggtcatcacgtcatcggcctggcccgctccgaggcttcggccgcaaccgtcagcggactcggcgccgaaccgctgcgcggcgacatcgccgacctcgacgtcctgcagaaggcggcggtcgacaccgacggcgtcgcctacctggccttctcacacgacttcagcgacgtcggggacgcgatcgcggacgaggcccgcgcgatcgacgcgctgggggccgcgctcgccgacaccggcaaaccgctggtgctggccagcgggaccccggcccggcccggctcggtgagcaccgaggacgaccccttcatcgccgacgggccgctggccgggcgcggccgcaccggccaggccgtcgtcgcgctggccgggcgcggtgtccgctcggccgtggtgcggctgccgcgcgcggtgcacgatgccggcggccgctacggcctggtgggcatcctgatccagctcgcccggcagcgcggcgtgtcgtccttcgccggcgacggcacccaacgctggccggccgtgcatcgcgacgacgccgcggcgttgttccggctcgccctcgagcaggccccggccggctcggtgctgcacgcggtgggggacgagggcgttccgctgcgcgcgatcgccgaggtgatcggccgccggctcggcgtgcccgtcgagtccgccccggccgacaccttcggtccgctcggccaagtcttcgccgtcgaccagccctcgtccagcgcgctgacccagcggcgcttcgggtggcagcccgtcggccccggcctgctggacgacctcgaaaccggcgtctacccggaataggtcacgagaaggtggtcaccgcgcaggtgctgggcgaggtgatgttgaccccggagtagaccacctggatgtgggtgcacaggatgacgttgttgtcggtcttgggctggccggtctgccagtcggtggagtcgatgcggccatgggcttcgtacttgtccggcgggccctcgcccatgtagatggtggtgatctcgtcggatcccatcgacttgtgcacccgctcgtactggccgtcggcgtgcgcgtcgaggtaggccagccggttggaggaccggatctcgctggtttgccgggcccacaggccgggcgggaagccggtcacaccgtcgggggtgagcatgtccgccccggcggtgaaatcgcagtggccgtcggacttgaagcagttgagcagggcccgggtctccagctggttgggaccgtccagcgggaacagcgtggtggcggtgttgctggcggcggcgcacaccccggcgggcagaaacatcggcagcgccgccgccaccgcgaagcccgacaccagccgcatcatcgctgcttcccttccctgtaatcccaccggtgaacttaacccgcgactactcgtcgtaggtgacttccaccgaatcagattccgggtgagattgacaggccaggatcaggccctcgtccaggtcctgctgctcgagcacgtcgttgacctccatgctgacctggcccttgcgcagggtgcaggcacacgcgccgcagtggccctcgcggcaggagaacggcgcgtcgaggcccttggccagcagcacgtcgagcagcttggcgttgcgcggccacgacacggtgtgggtttccccgtcgagctccaccaccgcggtggccggcggctcatcgccctcggcggtgtcctcgatcttgaccgccgcgaacgggtcggagtccagcgacttgaacacctcgatatgtatttgcgccgcaggcactttcagcgtttccagggcctcacgcgccgagtccatgaaggcgcccgggccgcagatgtagaccggccggtcggtgtagggggcggccagctgggccagcgcggtcacgctgggcaggccctgcagcgattccagccagtgcagcacggtgagccggtcgggatatttggcggacagctcgcgcagcgcgtcggcgaagatcaccgaacgctcgtcgcggttggcgtagagcagagtcacctgcccgctgccctccgacagcgccgacttggcgatcgacatgatcggggtgatcccgctgcccgcggccatcaacaggaagtcgtcgcccagcgtcttgggcacgaagttgcccgacggcgccagcacgtggatccgcatccccgggcgcgcgttgtcgcacagccagttggacgcgtagccgtccgcggtccgcttgaccgtcacggtcagcgcgtcgtcggtgaacggtgagctgcacagcgaatagcagcgcgccaccgatccggtgcgttcgctgggcacccgcagcgtcaagaactggcccggggcgtagcgcagccgctcgggcgggatgtcggggtctccgtcgtcgtccggcaccgcgaacaccagcgaccgcgcgtcgtcggtctcggcgatgacctcggcgatctgcagttcgaggacgtggtcaccgagcggctcgtcgagtgcttgggccgaatcagcctcggtcaaggcccgtccctccctttcgtggcaaaacgtgtcgacccgctgcgaccggctccgccgctcttgcgatcgccacaggcaactagaacatgttacagaaaagcggattcgtatcgctaccagccgcaggaataccctgctcgacacgaatcggaacgtgttctagtctctggggtaagtccgctgagtaagtttggcccaggaaggcaaacctagtgacgtccattcaacagcgtgatgcccagtccgtcttggcgggcatcgacgatctgcttccgcggattcgggagcgcgctcaggccacggaggatctgcgccggctgcccgacgagaccgtagccgaccttcaggacgtcgggttcttcaccctgctgcagcccgagcagtggggtgggctgcagtgcgaccccacgctgttctacgaggcggtccgccggctggccagcgcgtgcggttccaccggctgggtgagctcgatcatcggcgtgcacaactggcacctggccctgttcgaccagcaggcccaggaggaggtctggggcgaggaccccaacgtgcggatctcctcgtcgtatgcgccgatgggcgccggcgtggtgaccgacggcggctacctggtcaacggttcgtggaactggtcctccggctgcgaccacgccacctgggcgttcctcggcggcccggtgatcaaggacggccgcccggtcgacttcggcagcttcctgatcccgcgcagcgagtaccgcatcgacgacgtgtggcacgtggtcggcctgcgcggcaccggcagcaacaccgtcgtcgtcaaggacgtgttcgtgccgcgacaccggttcctgtcctacaaggcgatgaacgacggcaccgccggcggctatcagaccaacaccgcgccggtatacaagatgccttggggcacaatgcatcccaccaccatctcggcgcccatcgtcggcatggcatacggggcgtacgccgcccacgtcgagcatcagggcaagcgggtgcgcgcggcgttcgccggcgagaaggccaaggacgacccgttcgccaaggtccgcatcgccgaggcggccagcgacatcgacgccgcgtggcgccagctgtccggcaacgtggccgacgagtacgcgctgctgtccgccggcaaggagatcccgttcgaactgcgcgcccgcgcccgccgcgaccaggtgcgcgccaccgggcgcgcgatcgcctccatcgaccggctgttcgaggcttccggggccaccgcgttggccaatgaccaaccggtgcaacgcttctggcgtgacgcgcacgccggccgggtgcacgcggccaacgaccccgagcgggcctaccagatcttcggaaaccacgagttcgggttgccgccgggcgacacgatggtatgaccgcgaccgaggagttgacgttcgagtcgacctcgcgcttcgccgaagtcgacgtcgacgggccgctcaagctgcactaccacgaggccggtttgtccttcaagggcaccgggcgcacggtggtgctgctgcacggcggcggcccgggcgcggccagctggaccaacttcggccgcaacatcccggtgctggcccggcacttccacgtgctggccgtcgaccagcccggctacggcctgtccgacaagcgcgccgagcacggacagttcaaccgctacgccgcccgggcgctcaacgggctgttcgagcagctggagctgggacgcgttccgctggtgggcaattcgctgggcgggggcaccgcggtgcggttcgccctggactacccggacaaggccgggcggctggtactgatgggccccggcgggttgagcatcaacctgttcgcgcccgaccccaccgagggcgtcaaacggctgggaaagttctccgccgagccgacgcgggaaaacctcgaggcgttcctgcgggtgatggtctacgaccagaagctgatcaccgacgaattgatcgacgagcggttcgcgctggccagcacgccggaatcgctggcggccacccgggcgatgggaatgtcgttcgcgggggccgacttcgagctgggcatgatgtggcgcgaggtgcaccggctgcggcaaccggtgctgctgatctggggtcgcgaggaccgggtcaacccgctcgatggcgcgctggtcgcgctgaaaaccattgcccgcgcccagcttcacgtgttcgggcagtgtgggcactgggcgcaggtggagaaattcgacgagttcaacaagctcaccatcgatttcctgggaggtgcgtgatgagcaacggagccatcaggtcgctgggctatctgcgcatcgaggccaccgacatggcggcctggcgcgactacggcctgaaggttctcggcatggtcgagggcaagggcgacaccgaaggcgccctgtatctgcggatggacgatttcccggcccggctggtgatcgtgcccggcgagcgcgaccacctgctggaggccggctgggaatgcgcgaatgccgaaggcctgcaagagatccgggatcggctcgacatggagggcgtcccgtacaaggaggccaccgccgcgcagctggccgaccgccgggtggtcgagatgatccggttctccgacccgtcgggcaactgcctggaggtgttccacggggtggccctcgaacaccgccgggtggtcagcccgtacgggcacaaattcgtcaccggcgagcagggcctggggcacgtggtgctgtccacccgcgacgacgaggagtcgctgcacttctaccgcgacgtgctggggttcaagctgcgcgactcgatgcggatgccgccgcaggtggtcggccggcccgccgacggcgcgcccgcctggttgcgcttcttcggctgcaacccgcgccaccacagcctggcgttcctgccgctgcccacgccgagcggaatcgtgcacctgatgctcgaggtggagaacgccgacgacgtggggctgtgcctggaccgggcgctgcgccgcaaggtgcccatgtcggccaccctgggccggcacgtcaacgacctgatgctgtccttctacatgaagacgccgggcggattcgacgtcgaattcggttgcgagggaaggcaagtcgaagacgacgactgggtcgcccgggaaagcaccgcggtcagcctgtggggccacgacttcacggtcggcatgcgcggctgaccatggctgcgccgatcgatccgcggaccttccggcaggtgctgggccagttctgcacgggcatcaccatcatcaccacggtgcacgacgaggtgcccgtcggcttcgcctgccagtccttcgcggcgctgtcgctggacccgccgctggtgctgttctgccccaccaaggtgtcgcggtcctggaaggccatcgaggccaccggccgattctgcgtcaacgtgctgaccgagaagcagaagcacgtctcggcgcggttcgggtccaaggaacccgacaagttcgccggcatcgactggcatccctccgaactcggctcgccgatcatcgacggggccctggcccacatcgactgcaccgtggcctcggtgcacgaggggggcgatcacttcgtggtgttcggtgcggtccaatccctttcggaggcaccgaagatcaagccgcggccgctgctgttctatcgcggggaatacaccgggatcgagccggacaagacgaccccggcgcagtggcgcgacgacctggaggcgtttttgaccaccacaacccaggacacctggctgtaacgcgccgggcgcggacaatggtggcatgacgctggatctgggcgcgtatttcgaccgcatcggttacggcggcaaggccgcgcccaacctcgaggtgctgcgggccctgatggccgcgcacaccggctcgatcccgttcgagaacctcgacccgctgatgggggtgccggtcgacgacctgagcccggcggcgctgaccgacaagctggtccaccggcgccgcggcggctactgctacgagcagaacggcctgctgggctacgcgctggccgaaatcggtttccgggtgcgccgattggccggccgggtggtgtggatgcagccgcccgacacgccgccgcgcgcccagacgcacacggtcttggcggtgacgttcccgggctcgcagggcgcctacctggtcgacgtcggcttcggtggccagacgttgccctcgcccatccgtttcgagaccggcaacgcccagcagaccacccacgagccgtaccggctcgatgaccgcggcgagggcctggtgctgcaggccctggtgcgcgatgaatggccgccgctgtacgtgttcggcacccgcaccgtgccgcagatcgacctgctggtgggcagctggtacgtctccacccacccgtcgtcgatgttcgtcaccgggctgatggtcgcgcggaccaccgccgacgcccggtggaacctggccgggcgcgagctgaccgtgcaccgcgcgcagagcagcgagaagatccgcctcgacgacgcggacgcggtgctcgacgtgctcggggagcggttcggcatcgacgtggccgggatcggccagcgcggcgcgctgctggcgcgcatcgagcaggtgctggacgcctgagggcgggatttggctagcgggcgcgcagccacgagcccagccgtcgcaccgcctcctcgatgtcggtggtggggccggcgaaggacagccggacgaacgagttgccccgtgtggtgtcgaagtcgatcccgggtgcgatggcaacgccggtctgttccaacaacttcgagcagaactccatggagttgtcggtgaagtccgagacgtcggcgtacacgtagaaggcgccgtcggtgggggccaggcgggtgatcccgatgccgcgcaggccgtccagcagcagcgcgcggttcttggcgtagtggtgcaggtgcccgtcggcctcggcggtggcctcgggggtgaaggcggccaccgcggccagctgcgacagcacgggcgggcagatggtgaagttgccggtcaggcattccaccgcgcggcgcagttcgaccggcaccagcagccagcccagccgccagccggtcatcgcgtagtacttcgaaaagctgttgaccaccacggcattccgcgaggtctgccacgcgcagctggtgggtggcgccccctcgtagaccaggccgtggtagacctcgtcgctgacgaggcgggccccggacgcctcgcaccaggacgcgatggcggccaactcctccggcgcgatcacggttccggtggggttggccgggctcgccacgatgacgccctgcaccggcgggtcgagttcggcgagcatcgccgcggtgggctggaaccgggtctgcggtccgcaggggatctccaccacctcacatcccaacgccgacaagatgtttcggtagcacgggtagccggggctggccagcgccacccggtcgccgacgtcgaagcaggccaggaacgtcagcaggaacccgccggaggagccggtggtgatcaccaccgcgtcgggctccacttccagcccgtgctggcgccggtagtccgcggcgatcgcggcccgcagctccggcgtgcccagcgacaccgagtagcccagctcgttggaatgcacggccgccgccgcggccgcgcgcaccggctcgggtgcgcccacgctgggctggcccgccgacaggttgaccaaatcgccgtggctgcgctgcctttcggccgccgccagccagacatccatcacgtagaacggtgtgatgccggcgcgcagcgagacgcggtcggtcacggtgtcgcgagcacctccggttcgagccgggtgagcagctgttgcggcgtgtcgagcagatgcgcgctgccgtgtgcgcgtttgaagtacaggtgcatgtcgtgctcccaggtgatcgcgatgccgccgtgcaactggatgccctcggcggccacgacattcagcgcctcggtggcggccagccgggcggtggcggcgttggtcggcgagggatccaggcaggcctcgtcgaccacggccttggccgcggcgacggtgacgtagaggtcggccatccggtgcttgagcgcctggaagctgccgatcggccggccgaattgcactctgtccttggcgtagtccacggtacgcgccagacactgctcggcggcgccgatctgctcggcggccagcaggacggccgcggtgtccgccaggcccgggtcggtgccgatcggctcggtctgctgcgcccggacccgcgccagccgccgggtcgggtccatggtggtcacgggttgcgcggtgacgccggtccagcggctcagccggccgtcctcgacgccgatgaccacgtcggcgatgtccccgttgaccacgtagtcggggtcgagcaccagcgcgccgatcgcgctgccctcggccagggcctgcagcgcggcggtgtcgggctcggcggcgccgagcagcgccagctcggccagcgtggtacccagcagcggggagggcaccagggcgcggcccagctcctgcaaaaccgttgccgcgtcggccaattcaccgccggcgccgcccagctcctcggggatcaccagcgccgcggcgccgacctgctcgcacagcagccgccacagcgattcgtcgtaaccgcgctcggactccatggccgtgcgcaccgccgccggaccggcgtgcttggccaccagcgcggcgacggtctcgcgcagcatctgccgttcttcactgatcgcactcatagcgcctccagcactcgctgccggtgaacctgcggcggaccccacgccgaccgcaccgcctgcacccgcaaaagcaacagcgacaggtcgtgttcctgggtgaaaccgatcgcgccgtgggtctgcagcgccgagcgcgccgccagcagggccgcgtcggacgccgccgccttggccgcgctgacgtcccgcggttgcagcgtcagggccgcgccgtacaccagcggccgggccagttcgatcgcgatgtgcacgtcggccagcttgtgtttgatcgcctggtacgagccgatcacccggccgaactgggtgcgctgcttggcgtagtcgaccgccgcgtcgcgcagcgcctcggccgcaccgaccagttgcgcagcggtggccagcgcgccgaattcgtagccgcgcccgatgtccgcctgccagcggtcgccggtcgcctcgacgtcatagagccggcggctggggtcgacggacgcgtgctgccagcccgcggcggcctcggccaccccgtcctggttggcgagcagtaccagcccggcctcctcggcgtcgacggcccgcggcacctgcggcggcagcgccacggtggcgatgagctcaccggaggccagggcggcgcagcgttcggcgtgctcgtcgccggccagcaataccggtgccacggcgatggattcgaccaccgggccgggcacacaccagcgcccgagccgctcgatggccaccaccagatcgatcggctcggcctcgatgccgtcgaatttctccggcacggccagcgcggtgacgccgaggttggccagctgctcccacaccttgcggccgggcgcggtgtcgcccgccgcccaggcgcgcaccgccgcgggcaggtcggccgcgccgagcgcggcgtcgatgctggccgcgaagtcccgctgctgttcgtctagcgcgaatttcacttcttgctcccggacttctcgcgcggcagccccagtaaccgctcggagatgatgttgcgctgaatctcgttggtgccggcgtagatcgggccgcccagcgcgaacagcagcccctcggtccacgggccggcgagttcgccgtcggcggccaggatgtccagggcggtctggtgcaattcgacgtcgaggtccgaccagaacactttggtcaccgacgattcggcgcccagctcaccgccggcggccagccgggtgaccgtgccgaaggtctgcagccggtaggcctgcgccttgatccagccgtcggcgacgcggtcggcgaactcggccggtgacccgcggtcctgccacaaccgcaccacccgctcggcggtggccaggaagcgggccgggctgcgcagcgacatgccgcgttcgttgctcgacgtgctcatcgccgcccgccagccctggtgcggggtgccgattacatcccggtcgggcacgaagacgtcgtcgaggaagatctcaccgaacccggtgtcgccgcccaactggacgatgggccgcaccgtgacgccctcggccttcaggtcgaacatgaaatacgtcaggccatggtgccgctcggcgctggggtcggaccggaacagcccgaagccccgctcggcgaacggcgcccgcgagctccagatcttctgtccgttcagcagccagccgccgtcggtcggtgtcgcggtggaccgcagtgacgccaggtcgctgccggactcgggctccgaccacgcctgcgcccagatctcttcgccgctagccattttcggcaggatgcggtcgcgttgctcctcggtgccgtgcgcgaacagcgtcggggccagcatcgaggtgccgttggcgctggcccggcccggcgccccggcgcggaagtactcctcttcgaacaccacccagtgcagcagcggcgcgtcccggccgccgtacttcttcggccaggtgatcaccgacagcccggcgtcgtagagtacccggtcccaacgccggtgctgctcaaagccttcggcgttgtcatacgacttcgtcgggatcgcctcggcgttggccgacaggaattgccgcacctcgtcccgaaacgccagggtgccctcgtccagatccagatccatcagtccagctctcgcagttgtggtttgaccaccttgccgccggaattgcgcggcaacgcgtcgacgaaccgcaccgaccggggtgccttgaaattcgccaaatgctcacgggtgtaagcgatcacggattgctcgtcgagttgggccccggggcgggggaccacgaacgcgcggcccacctcgccgagccgctcgtcgggaacgcgatgtcgccggtgtgcagccacccgtcggcgtcgatggcggccgccgtcgcgtccgggtcgtcgagatagcccagcatcacgttgggcccgcgcagcagcacctcaccggaatcgtcgatgcgcagctcgaagtcggcgaacgggcgcccgcaggtggtggccacggtgaccgcgtcgtcgtcggcgcggcacatggtgcccatcccgttggcctcggtcagcccgtaggcggtcagcacgatgtcgatgtcgagctcggactgcatccgctcgaccagcacgacgggtacggtggccgcgccggtcaccgcgaagcgcagcgagctcaggtcgtaatcgcggcgggccggatggtccagcagggtctggtaaatcgttgggggaccgggcaatacggtgatgcggtgctgctcgatcgcttgcagcgcgcgcagcgggtcgaacgtcaggtgcgggatcagcgtcgcgccggtctgcaggcaggccaggatgccggccttgtagccgaagttgtggaagaacgggttgatgcacaggtagcggtcgtcgctggtgatcttgccgttggccgcccaggacgccgacgccgacagcgactgccggtgcgcgcacagcacgcccttgctgcgaccggtggtgcccgaggtgaacaggatgtcgctgacgtcgtcgggcgtcacggcggccgcgcgctcggccaccgcgccgagatccgttccgtgcgcgatgaattcgtcccagctgcccgggacgggatcgtcggcttcgatcgggatccgcacgatgtggcgcagcgcgggcagcgcggcgcgatccaggtcggccaggcggtcgtggccgaggaacctgcccatgccgaacagcaccggcgcgccgacgcgggccaggatgtcgccggcctccgcggcggtgtagcgggtgttcagcgggaccatggccgccccggcgtggtggatcgccaggcaggccaccacccagtgccaggtgttgggcgaccagatcgccacccggtcgccggcccgcacccccagctcgatcagggccgcggcagcccggtgcacctcgtcgcgcagggcggcggccgtgaaggatcggtcctcggtgatcagagcgtcgtgatcgggcagccggcgcgcgagacgatccagcgccgcgggcacggtgcggggatcggtggtcacggcggcgctcctcgaatgcctgtaacaaagcaagtgcttggtaggttagcctacaaggcatgcaggacgtcgaggagttccgggccgaggtccgctcttggctcgccgacaatctggtcggcgaattcgccgctctgaagggcctcggcggccccggccgcgagcacgaggccttcgaggaacgccgggcctggaaccagcacctggccaaggccgggctgacctgcctgggctggccggtcgagcacggcgggcgcgggctgtccaccgcgcaccgggtggccttctacgaggagtacgcccgcgccgacgcgccggacaaggtcaaccacttcggcgaggagctgctcggccccacgctgatcgcgttcggcacccccgagcagcagcagcgcttcctgccccgcatcctcgacgtcaccgagctgtggtgccaggggtattccgagcccggcgccggcagcgacctggccaacgtgtcgaccaccgccgaactcgacggcgaccagtgggtgatcaacggccagaaggtgtggacctcgctggcgcacctgtcgcagtggtgcttcgtggtcgcgcgcaccgagaagggctccaagcggcacgccgggctgtcgtatctgctggtgccgctggaccagccgggggtgcagatccggcccatcgtgcagatcaccggcaccgcggagttcaacgaggtgttcttcgacgacgcccgcaccgacgcgtcgatggtggtcggccagcccggcgacggctggcgggtcgccatgggaacgctgaccttcgagcgcggcgtgtccacgctcgggcagcagatccgttacgcgcgtgagctttccaacctggccgagctcgcgcggcgcaacggcgccgccgacgacccgttcatccgggagcggctgacccgcgcctggaccgggctgcgcgcgatgcggtcgtatgccctggccaccatggacgtcgagcagcccgggcaggacaacgtgtcgaagttgttgtgggccaactggcatcgggctctcggcgagctggccatggacgtcatcggcaagcccggcatgaccatgcccgacggcgaattcgacgagtggcagcggttgttcctgttcacccgcgccgacaccatctacggcggctccaacgagatccagcgcaacatcatcgccgagcgggtgctcggcctgccccgggaggtaaagggatgagcctgtccgaagctccgaaagagattgcgggacacgggcttctggaaggcaaggtggtgatcgtcaccgcggcggccggcacgggtatcggctcggcgacggccaaacgagcgctcgccgagggcgccgacgtggtgatctccgaccaccacgagcgacggctgggcgagaccgccgaccagctcgccgcgctcggccagggccgggtggaaagcgtgctgtgcgacgtgacgtccaccgcccaggtcgatgcgctgttcgcgtcggcccacgcccggatggggcgcatcgacgtgctggtcaacaacgccgggctgggcgggcagaccccggtggtcgacatgaccgacgacgagtgggaccgggtgctcgatgtcaccctgacctcggttttccgcgccacccgtgccgcgctgcgctacttccgcgacgcgccgcacggcggggtgatcgtcaacaacgccagcgtgctgggctggcgggcgcagcactcacagtcgcactacgccgccgccaaggccggggtgatggcgttgacccggtgcagcgcaatcgaagccgccgagtacgacgtgcggatcaacgcggtgtcgccgagcatcgcccggcacaagttcctggagaagacgtcgtcggccgacctgctcgaccggctctcggccggtgaggcgttcggtcgcgccgccgagccctgggaggtcgcggccaccatcgcgtttttggccagcgactactccagctacctgaccggcgaggtcatctcggtgtccagccagcatccatgagccggcgtggtcggccgggaccggcgcccctcccgctggccaagcaagcgcttggttgatactctgtccgggtggaccgagtgaccggtccggccaacagccggcgagacgagttgctggagctggccgcggccatgttcgccgagcgcggattgcgtgccaccacggtgcgcgacatcgccgacagcgccgggatcctgtccggcagcctgtatcaccacttctcctccaaggaggagatggtcgacgaggtgctgcgcagcttcctggactggttgttcgcccgctatcgcgaaatcatcgacagcgagagtaacccgctggagcggctcaagggcctgttcatggcgtcgttcgaggcgatcgagcaccggcacgcgcaggtcgtcatctatcaggacgaggccaaacggctgctgtcgcagccgcggttctcctacatcgaggacatgaaccgccagcaacgcaagatgtggctcgaggtgctcaaccagggcgtcgacgagggctacttccggcccgacctcgacgtcgacctcgtctaccgattcatccgggacaccacctgggtgtcggtgcgctggtatcagcccggcggaccgctcaccgccgagcaagtgggtcagcagtacctcgccatcgtgttgggcgggatcacggtggacgcgaagaaagactaacgaaggagtctgaaaatgcctgaggcgtacgtcatcgacgctgtacgcaccgcggtcggcaagcgcggtggatcgctggccggaatccatccggtcgacctgggcgcgctgggctggcgcgggctgctggaccgggtcgacgtcgaccccgccgccgtcgacgacgtgatcgccggctgcgtcgacgccatcggcgcccaggccggcaacatcgcccggctctcctggctggccgccggctatcccgaagaggtgcccggcgtcaccgtggaccggcagtgcggttccagccagcaggcgatttcctttggcgcgcaagcgatcatgtccgggaccgccgacctcatcgtggccggcggcgtgcagaacatgagccagatcccgatctcgtcggcgatgacggtcggcgagcagttcggcttcacctcgcccaccaacgagtccaagcagtggctgcaccgctacggcgatcaggagatctcgcaattccgtggctcggagctgatcgccgagaagtggaacctgtcccgcgaggagatggaacgctacgcgctgaccagccacgagcgcgccttcgcggccatccgcggcggccacttcgacaacgaaatcatcaccgtggaaaccgaatccgggccgttccgggtcgacgagggtccgcgcgagtcgtcgctggagaagatggccggcctcaagccgctggtcgagggcggccggctgaccgccgcgatggccagccagatctccgacggcgccagcgcggtgctgctggcctccgagcgggccgtcaacgaccacggcctgcaaccgcgcgcccgcatccaccacatcagcgcccgcgccgccgacccggtgttcatgctcaccggccccattccggccacccgctacgcgctggacaagaccgggctgtccatcgacgacatcgacaccgtcgagatcaacgaggccttcgcgccggtggttttggcctggctcaaggagatcaaggccgacccggagaaggtcaacccgaacggcggggcgatcgcgctcggtcacccgctgggcgccaccggcgccaagctgttcgccaccatgctcaacgagctggagcgcatcggtggccggtacggtctgcagaccatgtgcgagggcgggggcaccgccaacgtcaccatcatcgagcggctgtaacggttttcccgcgagctgccccttcgcgacactgcaactacgcacccgacacgccgatcgggatgtgcgtggttgcaatctcgtcggggcgcctaccgggtggccagcaccagcccgatgccgccgagggccagcagccagctggtgaagctgccgaccaggaagtactcggtcacctcgtcgatccccacgtcgccgttctgacccttctgggcgttcagttcgggaaaccggatgatgcccttggcggccacgacggcgctggccgcggccagctgcccgccgacgcccaggctcaggatcagcagccgttccatcgggcccagcagcctgccccccttgagccggtccgacggctgcggttggccggccgggcggacggcaccgacggagccgagcaccaggcgcaccagctgattcgcggtggcgaactgcaccagcacgacaccgacgaccatcagcgcccgggtgggcgggacgtggctcagcggcaggtgcgcccaggccgaccaccgcgagatcgcgccggcgaccggggaggaccagccggacaacaccgtcagcgacaccagcgccgcggccaacaccgccaccggggcggcctgctgggcaccgctgagttcgcttcgcgcgcacagccattcccacgcgaccaccgcgacggccgccagcgcgagcagcgcgatgtcggcgccgcgccagagcccgcccagcgccgcacacgccgccaccacgatcggcccgaccgccagcggcacccaggccgcagccaccgcacgccggcacaggtcggccatgccgagcgcggtgagcaggacggcgacggcgctcacggcagctcccgaaggtattggctggccaggacgatcagatccaggccgtcgcggccggcgcgttgggacaccgccgaggggctgatgccctcggccgcggcgagttcccttttgctccggccggtcatcaggcccctcacaatccgcagcgatctctcgtcgagtgatccaagcagatggtcccgacagatcagggccgcgttgatcgcgtcggcgtcggtgcgggtgccgtcgtcggcccggaaagtggtgcgcaccagcgccaacccgggctgccgctgcgcgtgggcggtctgctggatggccgctcgcgcggtccaccagcccggcccgtcctggattcccgcggcggcgtcgaggacggtgacggcgccccagccgagcccgaagcggacgtcgatctcgggggccagcagtaggcgcaccgtcagcgccgcgtcgatggcggccccgacgctgggatagctgccctggaactcgtcacccacggtgaaggccggcgggtcgatcgcgccgccggcgacttcccgcagagcggcggcgacgcggcgatgcagggcgggtcggtcggcggcgcgccgggatcccaccacgtcgccgatcacggtcgcccgtggtgaaggtttagccttcaccctcgccatatgaagatcatagcttcatacagaagatatttagcaatatccttaacggaagcgtgacccggaggcgatcgcgcggtggcctactcctcgatcagaccggacgcggaccgcaggtgcgcgatcgcgtcccggacgatcgagtcgatcagttcggcgcacgacggcaggtcttcgaggatgccggccacctgacccgacgccagcaccccggcctcggtgttgccttccaccagaccggctttcagcagcatcggggtgttggccgccatcaccacctgcgaccaggtcatctctttgccgtggcgcatggccaggccgtcgctgatcatcgaccgccaggtcatcttcgacatgtgcttgaatttcgccgcattgcgcacggccgcggtcaaaccccgcaccggcgaaccgctttccagcttctcgaccagcccggtgcgcagcacccggtgcggcattccgtcgacccgggtggtgacgacggtgccgtccagcgccgcttccaggtagcgcttcttgaccgcgtcgggcacggtcgaatccgaggtcagcaggaaccgcgtgcccatcgccacgccggcggcgccgtagctcaacgcggccgccaggccgcgcccgtcgaagaatccgcccgacgcgatcaccggaatcccggtgccccgcaccgcatccaacaccgacagcagcaacagcgtggtggcgaccggcccggtgtgcccgccgccctcgccgccctgcacgatcatcgcgtcggcgccccagccggcgaccttgcgggcgtgcttggccgcgccgatcgacggaatcaccaccgcgccggcctctttgagccgggcgatgagctcctgcttgggcgccagggcgaacgacgccaccttgacgccctcacggatcatcaggtccacccggtcggcggcgtcggcggcgtcggcgcggatgttgacgccgaagggcttgtcggtggcggccttgaccttggcgatcgccgtggccagctcgtccagggtcatggtggccgaggccaggatgcccagcccgcccgcgttggccgtggccgacaccagccgggcgccggccacccagcccatcccggtctgcaccaccgggtgctcgacaccgaccagctcggtcagcggcgtgcgtagtctcatatccaccgccgacgatgcagagcgcagcgatgaggaggaggcggaataatcgtcaacggatctccctgtcccgcagcgacttcgggtcgatgacctcgcggatcaggcgcagctcgtcgtcggtgggcagccgggtctcgtcggcctcgtccaggccgtggatctcgaacgaggtggcttcccgcacgtcttgcggcgacaccccggggtgcaggctcaccgcccgcatgctccggtccgggccgccgaagtcgaacacccccaggttggacaccacccgatgggtgttggcgaagcggaacgccgggttgtcggaatccacgttgtcccagccgatcccgcacaccacgtccaccttctcgcagaacacccgcttggagtggtttcccacccaatagctggtggcgtggttgatggcattgccgggcgcgccgcgcaccccgaacatctgacgggtgggctgctgcagcggtccgaacgctgagatgttttgattgccgaaccggtcaacctgattggcgcccatcaccacgtggcgccggccccaggacagcgtctcgaacacccggccgaacggcatccacccttcgacggccccggccgcaccgagcgccggggtgtcggccagcaactgcgcctcgccgtcggtcaacaggatgtcgggggagaacgtcaaccgggccagccgcgcgccgaccgaggccatgttggtcatcgggctgaccatgatttcgccggcgtccctgaacaattcggcgcaggcgacggcgcagatctcggcgcgggtgctggtcacttggcggcctcctcggcgaatgcgcgaaccgcggcctggtagtcgtcttcgttgccggacaggtaggtttgcacgaactgtcgccagccttcctccgtcgaggccgcctcggcgtagtgccgttggaacttctcgtcgcggccgtaatccggtgcggcggtggtgaagtgagcgccgttcggcgcctcgaccacggcgtcgaccatcatgcggttgaccagaagcgcctgcggcggcaccgccttgaccagctcctgggtggagaccacccgctccaccgacaggaagcgcttgtccgcggccatcaaaaaaaggtcgtcgaagtacggatcgatgccggtgtaggccgcattgccttgggcgtcaccgagattgaggtgcacgaaggcggcatccagccgcagtgcgggcatggcgatcagcgtctcgtgcgccccatctgttgggtagggcgaggtgaccgtctgcagctcgccctcccagaagtcgggcaccgaactgcccagcccggcccgaatcggcaggaacggcaaccggttcgcggcggcctgtaacccgcagcgcagcatgccctcgtccatttcgcgggcctggatcgccccgctggtccgcgccttggcgaaccacgggtcgtagaacggcggcgagtccagcgagacgaacccgtagtagacgcgcttgaccttgccggcagagcagagcagccccaggtccggcccgccgtaggtcaccacggtcaggtcggtgacatcggtgcgcagcagcgcgcgcacgaaggccatcggcttgcgccgcgatccccagccgccgatgccgatggtcatgccgctgcgcagctgcgcgacggcctcgtccaaagaggtgcgtttgtcggccactatttcttgcccttctgggtgccggcgaatgcgtcgcggtgctcgtcggacaccccggccagattgagctcgaacgtaaagccttgctccatccggtaactcgagttgacccgctgcacgtcgatgaagttcagcgcctccttggccgcccggatgacccgggtgtccttggcggcgatgtcgcgcgcgacccgcagcgccgccgcgtccagctcgtcgcgcggcaccacctcgtgcaccgacccgaagtggtgcagggtagcggcgtcgacggtggcggcggtgaagaacagccggcgcatcaggtgctgtggcaccagccgggacaggtgggtggcggcgccgagcgcgccgcgctccacctcgggcagcccgaaggtggcgtcgtcggaggcgacgatgacatcggagttgccgaccaggccgatgccgctgccgacgcagaatccgttgaccgccgcgacgacgggcaccgcgcactcgtagaccgcccggaacgcggcgaagcagccgcggttggcgtcgatcagcgcggtgaatccctcggtgcgctgcatctccttgatgtccaccccggcgttgaagccgcggccctcggcccgcaggatcaccacgtgggtctcggggtcctggccggccgcggtgacggtgtcggcgaggtcgaaccagccgcgcgaagggatggcgttgacgggcgggaagtcgacggtgaccgcgacgatgcccggttcgatggttttggatgtgatgggcaaggtgccacttccttgtggggtaactacctaagcaagcacttgcttggtacgctagcacagtgactcgcgccgaagcatgccccccgtttgcagaagccatcaacctggggctgaccggtcgggtggtcctggtcaccggcggagttcgcggggtcggtgccggcatcagctcggttttcgccgcacagggcgccaccgtcgtcacctgcgcgcggcgggcggtcgaggggctgccgtatgagttccactcctgcgatgtccgcgacgacgacgccgtcaaggcgctgatcgataccatcgccgaccggcacggcaggctcgacgtcgtggtcaacaacgccgggggatcgccctacgtgctgaccgcagaatccagcgccaagttcaaccgcaagatcatcgaactgaacctcattggcgcgctgtcggtttcgcagcacgccaacgctcacatgcagaagcaggcccagggcgggtcgatcgtcaacatctgcagcctgtccggccgccggccctcgccgggcaccggcgcctacggggcggccaaggccggcctggaaagcctcacccagaccctggcggtggagtgggggcccaaggtccgggtgaacgcctgcgtggtgggcatggtggagaccgagcagtcggagctgttctacggcgacgccgactccatcgccgcgatctcgaagaacgtgcccctgggccggttggccaagccggccgacatcggttgggccgcagcatttttagcctccgatgcggcctgctacatcagcggggcctcgctggaggtgcacggcggcggtgagccgccgcactatctggccaccacgaacgcgagcgcgatcaagtagaggagacaaggactatgggagtggttgacggccgcgtcgtcatcgtcaccggagcgggcggcggtatcggtcgcgcgcacgcactggccttcgccgccgaaggggcgcgtgtggtggtcaacgacatcggggtgggcctggacggttcaccggccagcggcggcagcgccgcccagagcgtggtggacgagatcaccgccgccggcggggaagccgtcgccgacggatccaacgtcgccgactgggaccaggccgccggtctgatccagaccgccgtcgaaaccttcggtggtctcgacgttttggtgaacaacgccggaatcgtgcgcgacaggatgatcgccaacaccagcgaggaggagttcgacgccgtcatcgccgtgcacctcaaggggcgcttcgccaccatgcggcacgccgcgtcgtactggcgggggctgtccaaggcgggcgaggccgtcgacggccggatcatcaacaccagctcgggcgccggcctgcagggcagcgtcgggcagggcaactacagcgccgccaaggccggtatcgcgacgctgacgctggtcggcgcggcggagatgggccgttacggcgtcaccgtcaacgcgatcgcgccgtcggcccgcacccggatgaccgagaccgtgttcgccgagatgatggcaacccaggaccaggatttcgacgcgatggccccggaaaacgtgtcgcccctggtggtttggctgggcagtgcggaggcccgcgacgtgaccggcaaggtgttcgaggtcgagggcggcaagatccgggtcgccgagggttgggcgcacggcccgcagatcgacaagggcgcgaggtgggatcccgccgagctggggcccgtcgtcgccgacctgctcgccaaggcccgcccgccggtcccggtctacggcgcctaacgcgccagacgcgcccaacgcactcaacgcacccgacgcaccctcgccgccgaacgtgcacccaccgcgagaattccgccgattcttcgctaccagtgcacgctcgacgacggcgaggtgcctagttgccgatccggttcacgggtcgcagatcacgaccgggatcacccggtcggtccacgactgatagtcgtcgaacgagggatacatggccaccagtttcggccagtactgttcgcgttcctcgggcgtggcgtcgcgcgcctgaagttgcagcacctcgtctttgatctgcacggacactttcggattcgccttgaggttgaggtaccacagcggatgcttgtcgcggccgccctgtgaggcaaccaggatcacccgatcgccctcgcgcaggtacagcagcgggctcacccgcggctgcccggtcttgcggccggtggtggtcagcagcgccaccgggcgtttctggaacgtgccgccccacttgcccctgctgacgcggtacatccaggtgttgacccgggacatccacttgatgaagaacccggtcatcggcgaattcaaggatttgggtttttccactgcgctactgccgtcctcgcgtctggatgaagggttggaagcgaaccttgatgtgctggatttcggctctgccgcttgggctttcggccggaatcaggaaggtctcggtgacgtgcgcggccagtcggcgcccgcccagcgccgccttggtgagcacctggtaggacgcgtgcacccggtcgccgtcgatgcggtagtccggggtagtggtgtgcgcgagcaaccggtactgcggaccgcgattgaggctgcggcgcaggtgatttcccgagaacccgttcttgattccctgctcgacgcgggtgcagccgggcgcgaacggaacggcgtcgccgtcatggctgaccagggcgtcgatgtaggcctgcgccgcggcgatgcggctttcgtccgagacgctcaccaccgaagccggaccggggacctagatgcgttcgatgatggtgccggtggacagcgcaccgcccgcgcacatcgtgatcagcgcggtggtctgatcggagcgctccagctcgtgcagggcggtggtgatcagccggctgccggtgcaccccaccgggtggcccagcgcgatggcgccgccgttgacgttgacccgggccatgtccggctcgtgcacccgcgcccacgacagcaccaccgaggcgaacgcctcgttgatctcggtgatgtcgatgtcgcccatcttcatgccggccttttccagcaccttggcggtggactgcaccgggccgtccaggtggtagtacggctcggcgccgaccagcgcctggctgatgatgcgggcccgcggccgcaggccgagcgccttggccttgtcctcgtccatccacagcacggccgccgcgccgtcggagatctgtgacgacgtgcccgcggtgtggatcccgccctcgatgaccggtttcagcgcggacagacccgacagggtggtctcgcgcaggccctggtcgcggctgatggtgacgcgctcggcggtgggctgcttgttctcgtcgagggccggcgccacgatcggcgagatctcacggtcgaaacggccctcgtcccaggcctgtttcgccttggcctgggaggccagaccgaactcgtcgatgtcttcccgggtgatgccgcggcgcttggcgatccgctcggccgcctcgaactggttgggcatgtcgatgtcccacgactcggcccgccagttgtggtcggggcccgcgttggcgcccagcccgacccggctcatcgcctcgatgccgcaggcgatgcccacttcgatggcgccggtggcgatcaaacccgcgatcaggtggttggcctgctgcccgctgccgcactggcagtccacggtggtggcgccgacgtggtcgggcaatccggcggtgagccacgccgtccggctgatgttgttggactgctcggcgtactgcgtgacgcaaccgccgatcacctgttcgacgtcgccggcgtcgatgccggccttctcgaccacggccttctgcaccgccccgagcagctcggtggcgtgcagccctgacaaccagccgttgcgcttgccgatcgggctgcgggtggctgcgacgattaccgggttacccatgcccgtcaggctagaacacgtttcattactatgacaagcgaggatgtgtcgccgccttttgtctgcggtggaggcatgttttactggcaccagagcatcactaggacagctagtgtcctgggatcgcaagtcagcgaggactgtagttaggagaagagcgtgcccagtccgaatcttccacccgggttcgaccttctggacccggacgtctgcgtcaagggcctgccggtcgccgaattagccgaactgcgcaagtccgcgccaatctactgggtggacgtccccggcgggaccggcggcttcggtgacaaaggctattgggcgatcaccaagcacaaggacgtcaaagagatctccgtgcgcagcgacatcttctcgtcgcagcaggactgcgccatcccggtctggccgaaggagatgacgcgcgagcagatcgacctgcagcgcaacgtcatgctcaacatggacgcgccgcaccacacccggctgcgcaagatcatctcgcgcggtttcaccccgcgggccgtcggccggctgcgtgacgagctggacgcccgcgcgcagaacatcgccaagaccgccgccgcggccggcgccggcgacttcgtcgagcaggtctcctgcgagctgccgctgcaggccatcgccggtctgctgggtgttccgcaggaggaccgggacaagatcttccgctggtccaacgagatgaccggcaacgaggaccccgagtacgcgcacatcgacccggcgatgtcgtcggccgagctgatcatgtacgcgatgaagatggccgaggagcgggccaagaaccccggcgacgacatcgtcacccagctgatccaggccgacctcgacggcgagaagctctccgacgacgaattcggtttcttcgtggtgatgctcgcggtcgccggcaacgagaccacccggaactcgatcacgcacggcatgatcgccttcgccgacaaccccgaccagtgggagctgttcaagaaggagcgcccggagaccgcgccggacgaaatcgtccgctgggcaacgccggtcacggcgttccagcgcaccgcgctcgaggattacgagctgtccggggtgcagatcaagaagggccagcgggtggtgatgttctaccgctcggcgaacttcgacgaagaggtcttcgaggatccgcaccgcttcaacatcttgcgaaaccccaacccgcacgtcggttttggcggtacgggtgcgcactactgcatcggcgccaacctggcccggatgaccatcagcctgatcttcaacgccgtggccgaccacatgccggacctcaagccgctgtcggcgcccgagcggttgcggtcgggctggctcaacggcatcaagcactggcaggtcgactacaccggcaagtgcccggtggcgcactgagatggcgtcagaaacgacgatggacttcgaccccagtccgacacaacaggcggtcgccgacgtcgtcacgtcggtgctggaccgcgaattgagttgggaggcactggtcgacgggggtgtgacggcgctgccggtgcccgagcgtctcggcggcgacggggtgggtctgcccgaggtcgccacggtgctcaccgaagtcggtcgccgcggcgccatcacgccggcgctggccacgttgggttttgccgtgcttccgttgctcgagctggcctccgaggagcagcaggaccggttcctggccggggtcgccaggggcggggtgctgacggccgcgctcaacgaacccggtaccccgctgccggaccggcccgcgaccaccttcgccgacggccggttgtcgggcaccaagatcggcgtcggctatgcggcacaagcggattggatgatcgtcaccgccgacagtgcggttgtcgtggtctcgcccaaggccgacggcgtccaggtggtgcagacgccgacctcgaacggctccgacgagtacacggtcagcttcaccggcgtcgcggtggccgattccgacgtgctggcgggcgccacggcggcgcgggtcaaccagctggcgctggcggccgtgggcgcctacgccgacgggctggtcagcggggcgctgcggttgaccgccgactacgtggccaaccgcaagcagttcggcaagccgctgtccaccttccagaccgtggccgcgcagctcgccgaggtctacatcgcctcgcgcaccatcgatttggtggccaagtcggtggtgtgggggctgtcggagggccgggatgtcgatcacgacctgggcgtgctgggatactgggtggcgtcgcaggcgccgccggcgatgcagctctgccaccacctgcacggcggcatgggcatggacatcacctatccgatgcatcggtactactccacgatcaaggacctgacccggctgctgggcgggccgtcgcatcgcctggacctcgtggcgatcgcaagcgcggcgcagccgggcgcagcgggtcggcacgcagacgacctggtgggagcgcaatgttcatagacctgacccccgaacagcgtcagctgcaagccgaactgcgggaatacttttcgaacctgatctcgtccgacgagatgaaggcgatggagcaggaccgccacaacgaggcctaccgggcggtgatccggcggatgggccgggacggcaagctcggggtgggctggccaaaggagttcggcggcttgggcttcggcccgatcgagcagtcgatcttcgtcaacgaggcgcatcgcgccgacgtgccgctgcccgcggtgaccctgcagacggtcgggccgacgctgcaacagttcggcagcgagatgcagaagaagaagttcctgccggcgatcctggccggcgaggtgcacttcgcgatcggctacaccgagccggaggccggcaccgacctggcgtcgctgcgcaccacggccgtgcggcagggcgacgagtacatcgtcaacgggcagaagatcttcaccaccggtgcccatgacgccgactacatctggctggcctgccgcaccgatccggaagccgtgaagcacaagggcatttcgatcctgatcgtggacaccaaggaccccggctactcgtggacgccgatcatcctgtccgacggcgcccaccacaccaacgccacctactacaacgacgtgcgggtgcccgccgacatgctggtcggcgaggagaacggcgggtggaagctgatcaccacccagctcaacaacgagcgggtgatgctgggcccggccggccgtaccgccggcatctacgacagggtgcgcgaatgggcgtccaagccgggcagcgacggggtcaccccgatcgaccacgccgacgtccagcgggcgctcggtgagatctatgcgatgtggcggatcaacgagttgctcaactggcaggtggctgcggccggtgaggacatcaacgtcgccgacgccgcgtcgacgaaagtctttggcaccgagcggattcagtacatcggccggctcgccgaggaagtcgtcggcaagtacgggaaccccgccgacccggagaccggcgaactgctcaggtggctggactcgcaaaccaagcgcaacctggtgatcacgttcggcggcggtgtcaacgaagtgatgcgcgagatgatcgccgccgccgggctcaaagtgccgagggtgccccgatgaccgacatcgccgaagccatcgcggagatcaaagccgccggcgggccgaaaccgcgcgccgggcgcgacccggtgaatcagccgatgatcaacaactgggtggaggccatcggcgaccgcaacccgatctatgtcgacgaggccgcggcccgcgccgtcggacatcccgggatcgtggccccgccggccatgattcaggtgtggaccatgttcggcctgggcggtgagcgtcccaaggacgaccccatggggcccatcatggagttgttcgacaacgccgggtacgtcggtgtggtcgccaccaactgcgagcagacctaccaccgctacctgcggcccggtgagcaggtcagcatcacctcggagatgggcgatgtgatcgggcccaagcagacggcgctcggcgagggctggttcatcaaccagcacatcatctggcgggtcggggacgaggatgtggccgagatgaattggcgcatcctcaaattcaggccccgcgaatccgacgcggcggcgtcgccggtgcccgacgacctcgatccggccaccatgatgcggcccgcgtcgtcgcgcgacaccgccttcttctgggagggtgtcaaggcgcacgagctgcggatccagcggcggccggacggcagcctgcagcacccgccggtgccggcggtgtggcaggacaagaccgcccccatcgactacgtggtggccagcggcaagggcacggtgtacagcttcgtggtgcatcacgcgcccaaggtgcccggccgcacactgcctttcgtgatcgcactggtcgaactcgccgagggcgtccggatgctgggcgagctgcgcggcatcgacccggcccgggtgcggatcgggctgccggtgcgggccacctacctcgatttcccggccgacgacaacggtccggagtggagcctctacgcctgggagcctgacgcatgagcgcacccgtcatcgaagtcggcaccacgttgcccgagctcaagctgtacggcgacccgacgttcatcatctcaaccgccctggccaccagggactttcaggacgtgcaccacgaccgggacaaggcgcaggccaaggggtcgaaggacatcttcgtcaacatcctcaccgacaccggcctggtgcagcgctacgtcaccgattgggccgggccgtcggcgctgatcaagtcgatcggcctgcgtctcggtgtgccgtggtatgcctacgacacggtgacgttctccggcgaggtgaccgccgtccaggacggcctggtgacgttaaaggtgttcggccgcaacagccttggcgatcacgtcatcgcgaccgtgacgctgacgatgggggatgcctgatgctttcccgcaaggcggcgatcgtcggcatcggcgcgaccgacttttcgaaggattccggccgcagtgagctgcggctggcggccgaggcggtgctggacgccctggacgacgccgggctttcgccggcggacgtcgacgggctgaccaccttcacgatggacaccaacaacgagacggccgtcgcccgcgccgtcggcatcggtgacctgaagttcttctcccagatcggttacggcggcggggccgcctgcgcgaccgtgcagcaggccgcgatcgcggtggccaccggggtggccgacgtcgtggtggcgtaccgggcgttcaacgagcgctcgggcatgcggttcggtcaggtgcagacgcggctggcgggagatgctcgcgcgcaggcggattcgaccgcggcggacaattcgttctcctacccgcacgggctgtccacgccggccgcgcaggtcgccatgatcgcgcggcgctacatgcacctgtccggcgcgaccagccgggacttcggtgcgatctcggtggccgaccgcaagcacgcggccaagaacccgaaggcgtacttctacgagaagccgataaccattgaggaccaccagaattcgcggtggatcgccgaaccgttgcggctgctggactgctgccaggagaccgacggtgcggtggcggtcgtggtgacgtccgtcgagcgggcacgcgacctcaagcagcggccggcggtcatcgaggcggcggcgcagggctccagccccgaccagtacacgatggtcagctactaccgctcggagctcggcctgcccgagatgggcgtggtgggccggcagctgtggcagcagtccggcctgaagccgaccgacattcagaccgccgtgctctacgaccacttcacgcccttcacgctgattcagttggaggagttgggattctgcggcaagggtgaggccaaggagttcatcgccgacggcgccatcgagatcggcgggcggctgccgatcaacacgcacggcggccagctcggtgaggcctacatccacggcatgaacggcatcgccgagggggtgcggcaactgcggggcacctcggtgaacccggtgcccgacgtcgagcacgtgctggtcaccgcgggcaccggtgtgcccacctcgggcctgatcctgggctagcttcccgccttcgctcgagcgtcaagttagcgtcacgctcgcggccgagcgtgaaattaacatcacgctcgacgagtgaagtgacggtgcgcgggtcgcgtgcgacgctgccgtcgtgggtgagccgttcctcggcagtgaggccgtagcgcgaggcgtgttgacgagaagtcggctgagcactggctacacccggctgttccgagacgtgtatgtcagcagagacgacgaggttaccgccgtgctgcgcgcgagggccgggtggctgtggagcgggcgccgggctgtggtcgccgggttctccgcggcggcgctgcatggaagcaagtgggtcgacgccatgacggtggtggacctcatccaccacaaccgctaccgccagcccgggatcagggttcatggagaccgtatcgaagaagatgaaattacggtcgtagacgggattctggtgacctcggcggccagaacggccctcgatctcggttgctggtacccgaccaccgcagcggttgccggcatcgatgcattagcccgcgaaacccgaatcaaggcggccgatgtcgagctgctcgcgcagaggtacccgggacgccgcggcatcgtccgggcaagggaagctatcgcactcttcgacggtgggtcgcagtctcccaaggagtcctggctgcgcgttgttttgacccaggccggattaccgccaccacagacgcagatccgggtcgttgacgaccttggcgacccggtggcctacctcgatatgggttgggaggacttgaaagtcgcggtcgagtacgacggtgaccatcatcgcagcgaccggcgtcagtatggctgggatattcgtcgctcggaaatgctgcagcgactcggttggatcgtggtgagggtggtcgccggggaccggcccgccgacatcattgcccgggtacgcgaggcgcgcgcccgccgaacgtgaaactagtttcacgctcggcggcaaaacggcgagaaggccccgcagctacgccgggaccagctcgacgccggagagcacgacggcgttgtcgcgcgaaggcgcgacaacgctggccagaaatcgcccaccctctttccagatgccgaccttcagcgtttcgccggggaaggccaccccagcgaaacgcgcgccgtaggccgccaccgcgccggcgtcgccgtcgagcagggcgtcgacgatcgccttgcaggtcatgccgtaggtgcataacccgtgcaggatcggctgggaaaaccctgcggcagcagcgaattcgggatccgagtgcagcgggttgcggtcgccgcacagccggtacagcagcgcctgctgcggcaggatcggcacgtcgacctccacgtcgggcgcccgctccggcgcggcgtcgccccccgacgggccgcgttccccgccaaagccgccctcgccgcgggcgaagatcgagcgcttctgcgtccacaacagggtgccgtccggcgcggtcaccttcgtctcgctccagatcaccgcggccttgcccttgtcccagatgtcggtgaaccgggtgacggcgcgcgcggagcccgaaggcggcagcggagcgggcacctcgacccgctctgacgcgtgcagcaccttgcccagctcgatgtcgatgccggggaactgcacggtcggcggcttggtggcgtggaaggtggcggccacgttgccgaacgtcggcagcacctgcggggtgtcgtcgaccaggtagcgcagttcgcgcggatccatcgggtcggaccccgcgcccagcgccaggtggtagagctggacatcactgctggcccaagagaattcgatgggatccagctcggcgttcagcgcgacgtctacgtcgatcggcatgtcagttctctcccgcgatgtgcagcgccgccaggtagccgaatgtcatggccggaccgatggtgccacccggacccgggtacgtgtggcccatcaccggcgcgctgacattgcccgcggcgtaaagaccttcgatgatactgccgtcgtcgcgcagcgcgcggccgtggatgtcggtgcggatgccacccttggtgcccaaatcgcccggcaccatcttggcggcgtagtagggcgggtggctgatctcgccgaggttgggattgggcttgttggtgggatcgccgtagtacctgtcgtaggcgctctcgccgcgatgatagtcctcgtcgatgccggtgcgcgcgaagccgttgaaccgctgcacggtggccaggaattcgtcgaccggaaggcccgcccgcgaggccagctcctcgagcgtgtcggcctggatgatgacgccggactccagccatttgcgcggaatgcgttgccctggttgcaatccggcaaagatgtagcggtccctgtactgctggtcgaacaccagccacgccgggatgttctcgcccggcccgggaccctgaccgaattcgccgccgtacatgtgatggcaggcctcgacatagggcatcgactcgttcatgaaccgcttgcccgacatgttgacgatgatcgaccccggcgaattgcgctcggacagcgcgaaccacggcgcgccgaccagcggcaccgtcggaccccaccaggcgtcttccatcaattccagtgcggcgcctagcttttcggccgccagaatcccgtcaccggtgttcgccttggcgcccacggtccactcggtggtgatgggcgcgcgctggtatttcacccgcatctgctcgttgtgctcgaagccgccgctggccaggatcacgccgcggcgcgcccggatcagccgcggttcggcggactcggccgcctgactgtcacggacatagacgccgcgcaccacgccgtcttcgaggtacaggtcggtcagcgcggtgttgagcaccaccgggacgccggcccgctgcaaaccgatgcgcagcggcccgatcagcgcccggcccatgccgaccaggttcttgccggtcgccttggcccacatggtgcgggcgccgaccttcaggctgcgcagcacaccccgcgggtggcgcttgagctggttcaaccgcacgtagtcctgttgcatgacaacgacgttcagcggcaccttgccgtacgccggttccaggccggcctcgtcgggccccagcttgcgggcgttgaacggcttcggctcgatcgaccggccctccgcgcgtccgcccggcgactccgggtagtagtcggagtaccgcggtacccagcacatcttcaacggcgtgtgcttgagcacgaaggacagcatctccggcccgcgttccaggtaggtgtcgatgcgttccggctcgacgacgtcgccgatgatcccgtgcagataggtgcgggccgcctccggggtgtccttcaccccatcacgcttgagcacttcgttatttgggatccaaacaccgccgcccgaccgcgcggtcgagccgccgaagtggggggccttctcgatgactatggtggaaagaccccggtgagcggcggtaagggcggccaccataccggctccgccgctcccgaccacgacgacgtcgtactcctgcgctgacatgtagaacacgttatagaattgcccggggcggccgctactggcccggtcgaccgtacgaggagactgcaagaaaatgctcagtgttgccacccgcgacgagctggctgccgagttggcgcaggccgagcggagcggtgagcccatcccaccgctgaccgccgcctaccccgagatcgacgtcgtcgacgcgtatgagatccagctgatcaacatccggcagcgggtcgccgagggcgcccgggtgctgggccacaaggtcgggctgtcgtcgttggcgatccagcaaatgatgggcgtcgacgagccggactacgggcatctgctcgacgacatgcagttgttcgaagacaccccggtcaagacgaaccgctacctctacccgcgggtggaggtcgaagtcggcttcatcctgaacgccgacctgccgggggcgggctgcaccgaggacgacgtgatggcggccaccgaggcgttcgttccggccatcgagctgatcgacacccggatcaccgactggaagatcgagttgtgcgacaccatcgccgacaacgcctcgtcggccggcttcgtcctgggtgcggcccgggtgtccccgcaagacattgacatcaaggggatcgacgcggtgctgcgccgcaacggtgaggtggtggccgagggccgcaccgacgcggtgctgggcaacccggtgaccgcggtggcctggctggcccgcaaggtggatggcttcggggtgcggctgcgcaagggcgacgtggtgttgcccggctcgtgcaccaaggcgatcgacgcgcaccccggcgacgagttcgtcgccgacttcgcgggcctgggttcggtgtgtctgtcgttcgaataggctcgagttaaatcgaccaacttaaatctcaacagcttcgtaaggagcgtcatgccgactaaagcaaaagtggcgattgtcgggtcggggaacatcagcacggacctgctctacaagctgctgcgatccgactggctggaaccacgctggatggtcggcatcgacccgcagagcgagggcctggcccgggcccgcaagctgggcttggagaccacccacgagggggtcgactggctgctggcgcagccggagaaacccgacctggtcttcgaggcgaccagcgcttacgtgcaccgcgacgccgcccccaagtacgaggccgccggcatccgggccatcgacctgacgcccgccgcggtgggcccggccgtcatcccgccggcgaacctgcgccagcacctggacgcgccgaacgtcaacatgatcacctgcggcgggcaggccacgatcccgatcgtcttcgccgtcagccgcgtcgtcgaggtgccctacgccgagatcgtcgcgtcggtggcgagcgtgtcggcgggcccgggcacccgtgccaacatcgacgagttcaccaagaccaccagccggggcgtggagaccatcggcggcgccaagcggggcaaggcgatcatcatcctcaacccggccgacccgccgatgatcatgcgcgacaccatcttctgcgctatccccgaggacgccgaccgggacgcgatcgcacagtcgattcacgacgtcgtcaaagaggtgcagacctacgtgcccggctaccggctgctcaacgagccgcagttcgacgagccgtcgctcaactccggtggccaggccgtggtcaccacgttcgtcgaggtcgagggcgccggcgattatctgcccccgtacgcgggcaacctggacatcatgaccgccgcggccaccaaggtcggcgaggagatcgccaaggagacgctggccacgacggcgggaggagcgcaatgactaccgatatcttcttcaacccgatttgggacgtccggctgaccgacacgtcgctgcgcgacggcagccaccacaagcgccaccagttcaccaaggacgaggtgcaagccatcgtcgcggccctggacgccgcgggggtgccggtcatcgaggtcacccacggcgacgggctgggcggctcgagcttcaactacgggttctccaagacccccgagcaggagctgatcaagctggccgccgagaccgccaaggacgccaagatcgccttcctgatgctgcccggggtgggcaccaaggaggacatcaaggaggcccagaacaacggcggctcgatctgccggatcgccacgcactgcaccgaggccgacgtgtccatccagcacttcggcctggcccgcgaactcgggctggagaccgtcggcttcctgatgatgagccacaccatcccgccggaaaagctcgcccagcaggcccgcatcatggccgacgccggctgccagtgcgtctacgtggtcgactcggccggcgcgctggtgctcgagggcgtgcgcgaccgggtggccgcgctggtcgccgagctgggcgacgacgcccaggtcggtttccacgggcacgagaacctcgggctcggggtggccaacagcgtcgaggccgtccgggccggcgccaagcagatcgacggctcgtgccgccggttcggggccggggcgggcaacgcgcccgtcgaggcgctgatcggcgtgttcgacaagatcggcgtcaagaccggcatcgacttcttcgacatcgccgacgccgccgaggaggtggtcgcgccggccatgcccgccgagtgcctgctcgaccgcaacgccctgatcatgggctattccggggtgtactcgagcttcctcaagcacgccatccgccagtccgagcgctacggggtgcccgcacaccagctgctgcaccgggccggtcagcgcaaactcatcggcggtcaggaagaccagctgatcgacatcgcgctggagatcaagcgcgagcaggaaagcggtgccgcggcggcgcgctgagccggggcgctttcgcacagccgacgcaaagcttgcgcgggtaacctggcgcgcatgagcacatccaacacagtcggcgcccgtcgccgcgggctgtacggcctgctcgccggggggttactcaccgctgccgccgcgacggtgatcgcgctacccgtggcgggcgtcgcccacgcggaatgcaatcaggacgtcggtcagtccatcgactcgtacctgcagaagcacccggacctgcaccagcagctgcagcaaaggtcgcaggccgagggtggcaacggcaacgtcatcgactacctcaatcggcatcccgacgtgcgccagcacctgatcgacctgtcgcactcctgcccgccctaggtgagccggcctcgtcgcgcgacgccgtgggcgacgcgcgggaacgttcgccattgacgaaaaagtagaacacgttctagcgtctaggcgtgttctctgatccgctcacctccgcgatcgccgaggccgaaaatctggtggccgccgcaccgcacatcgagaccgaagccgacctgctggagggactgcagtacctggccggctgcatctcggcctgtatccacctggcggtcgactacgagcgcgaccaccccttcctgcaatcgggcaccgggccgttcaccaagatgggcctggacaaccccgacacgctgtacttcggcacccgggtgcacgccggctacgactacgtcgtcaccggccgccgcggcaccaccaccgatttgagttttcagctgctcggcggcgagtacaccgacgacaacgtgccggccagccaggccgcgttcgacgaccgcgagctcgacatcgcgcccgacggcagcttcgagtggcgggtgcgaccgaccagcaacggccagctggtgatccgcgaggtgtacggcgactgggccgcccagcgcggcaccctggccatcgcacgggaggacaccgcgggcaccgcgccgccgccgctgacccgcgagacgatcgaaaagcgttatgccacagccggaaaacaactcgtgaaccgggtgaagacctggctgcagttcccgcagtggttctacttcaacatcccggtcaacaccatggtcgcgccccggttgacgccgggcgggctggcgacgcagtactcgtcggccgggcactacgaactgcggcccgaccaggcgctgctgatcaccatcccggtcaccgacgccccctacctcgggttccaactgggcagcctgtggtacatctcgctggactacatcaaccatcagacgtcgctgaacaacactcaggcgcaagcggatccggacggcaaggtgcgcatcgtcgtcgccgagcagaacccgggcgtgacgaactgggtggagacggtcgggcatcggaagggcttcctgcagttccgctggcaacgggtgtcgcgccagctcaccgaggccgacggccccaccgtcgagctggtcgacttcgacgccgtacccgccaagctgccctactacgagcacaacaagatctccgacgacgaatggcgggcgcgaatcgcgttgcgtcaacaacagattgcggcaaggatgctggggtgacgatggcagggatgctcgacggcaaggtggtggtcatcagcggcgtggggccggggctgggcaccacgctggcgcaccgatgcgccgacagcggggccgacctggtgctggcggcgcgtaccgccgagcggctggagaaggtggccaaggaggtcaacgacggcggccaccgggcgctggcggtgcgcaccgacatcaccgacgacgacgaagtcgcctacctggtcgagaccaccatggcgacctacggcagggccgacgtgctgatcaacaacgcattccgggtgccgtcgatgaaacggttggcgggaaccagttttcagcacatccgcgacgcgatcgagttgagcgcgctgggcgcgctgcggctgatccaggccttcacacccgcactggagacggcgcacggatccatcgtcaacgtcaactccatggtgctgcgtcattcgcaggccaagtacggtgcgtacaagatggccaagtcggcgctgctgtccatgtcgcagtcgctggccaccgagctgggcgaaaagggcatccgggtcaattcggttgcgccgggctacatctggggcgataccttgcaggcctacttcgagcaccaggcgggcaagtacggcaccacggtcgagcagatctacgcggccaccgccgccaactccgacctcaaacgcctgcccaccgaggacgaagtcgcttcggccatcatgtttttggccagtgacctgtccagcggcatcaccgggcagaccttggacgtcaactgcggggaataccacacgtgagcgatcgcaccgacatcggcaccgtcgaggagctgcacgcatcggccaccaagctgaccgggctcgacgacttcggcaccgacgacgacaactacctgcaggcgctggaagtgctgctggactcctaccgccgggaagccggccttacggtgttgggcagcaagatgaatcgcttctttctgcgcggcgccctggtggcgcgcctgctgtcggagtcggcctggaagcaatacccgcagtacgccgacgtcgcgatccaacggccgatcttcgtcaccggcctggtgcgcaccgggaccacggcgctgcaccggctgctgggcgccgatcccgcgcatcagggtctgcacatgtggctggccgaattcccgcagccgcggccgccgcgcgagacctgggagtccaacccgctgtaccgtcagctcgacgcgcaattcacccaacaccaccgggacaaccccggctacaccgggctgcacttcatggccgcctacgagctggaggagtgctggcagctgctgcggcagtcgctgcactcggtgtcgtatgaaacgctggcgcacgtccccagttacgcgcagtggctgtccgaacaggactggacgccgtcgtatcagcgccaccgccgcaaccttcagctgatcgggctcaacgacgccgacaagcgctgggtgctgaagaaccccagccacctgttcgcgctggacgcgttgatggccacctacccggatgcgctggtgatccagactcatcgcccggtcgaaacgatcatggcgtcgatgtgctcgctggcccagcacaccgccgagggatggtcgaccacgttcgtcggggcccaaatcggcgctgacgcaatggatacctggtcgcgggggctcgagcggttcaacaccgcacgggccaagtacaacccggcgcagttctacgacgtcgactacaaggagttgatcgccgacccgctgggcaccgtggccgacatctaccggcacttcggcctgacgctgaccgaggaggcgaaggcggccatggccaagacccacgccgacagccagtccggcgagcgggcccccaagcacagctactcgctggccgactacggcctcagcgtggagacggtcaaggagcggttcgccgggctgtgatcgcccgcgcagtcagtcgtccagatatccctcggcgacggcatgctcgatgctgtcgccgagcttcgggcaggacttggtgcgcgcggtattgcccccggcccggcggacctcggtgaaatacgcgcagcgctgccaggcttcggtgctccactgcaccgcggtgtgccccggcccgagccggcggacggcgacccgcgcgtggcagaaccggcagtccaccggcagcagacccgagttgaggtagcgctcccggtcggcgcggctggcctcggcgacggcggccgcgcgctgcggatcatcggtgaaatcccttgacttcgaccaggatccaccgttggccggcgacgcggcgggccgctcgtcgtggtcgtgatgatcgccgtggagcaacaacatcgaccgagcgagtcgatcgacgtcgggaaccgccggctgatcgtcggtcatggcggtcagtgttgttcggcgggaacgtcttcggactctttggccttcaggttctgcgcgacctcggcattccagtactcgttggcccgagtggtgtccacctcgatctcgaagcgctccaccatctccggctcgatgtcggcgacgtcgacgtagaactgctggtaccagcggcgcagctggtagacggcgccgtcctcctcgaccagcagcggattgtcgatgcgggtcttgtgcttccagatctcgacgtcctgcaggaagcccttgctgaccccctcggtgaacacccgggacagcttgtcggtcatctcctcgtccatgcccttgggcttctccacgatcacgccccactgcagcacgaacgagttctgcgtcaccgggtagtggcagttgatcaggatcgactcggccttgtagtcgccgtagctgttgtgcagccagttgatcatgaacgacggaccgaagtaggacgcctccgaatccaggtgtgcctcaccgtaagacgtgccgaggtcgttcacgtcggggcggcccacgttgtgcaggtactgcgacgcgatgtggccctcgaacacgttcttgaagtatgtcggcaacccgaaatggatgtagaagaagtgcgccatgtcggtgacgttgtcgatgatgtcgcggcagttggagccctcgatgaggatgcggttccaccgccagtcggtccactcgtcgctgtgcgcctccgggatctccgggatgcggacggccgggtccggcgggttgttctcgtggtcgtgccagacgaacagcagcccgccccgcacatcggtggtccacgaccgggtgcgcgccgtcttcggcgtgcgcttggcgtacggcaccagcttgcaccggccgtcgccgccccagcgccagtcgtggaacgggcaggcgacctcgtcgcccttgatggtgccctccgacaggtcaccgcccatgtgccggcagtagccgtcgagcacgtggatgtcgccgtgtgagtcggcgaagacgaccagtttggtgccgaacgcctcgatcgagtgcggcttgccgtcctggaagtcgtttgcgacgcccaggcagtgccagccacgggcgtatctggtcggcagggcgccgggatcgatctcccggatgccgaccggcttggtgtcggtagccacctgtcacctccaactcgctggccctctaactagaacacgttacagttttgcgccgggcccgcgcaacgaaggcaagcctgcctgggccgttccgcgagttcggcggcgctcaggtatatctagacgatgccgctgtttgctttcgagggccgctcgccgcgggtggaccccaccgccttcgtggcgccgacggccaccctgatcggcgacgtggtcgtggaggcgggggcttcggtctggttcaacgcggtgctgcgcggcgactacgggcccatcgtggtgcgcgagggcgccaacgtccaggacggttcggtgctgcacgcgccccccggcatcccggtcgacatcggtccgggggcgacggtggcgcatctgtgcgtcatccacggcgcgcacgtcggccccgaggcgctgatcgccaaccacgccaccgtgctggacggcgcggtgatcggcgcgggcagcctggtggcggcgcattcgctggtcaccgcgggcacccagattccggccgggatgctggccatgggcgcgccggcccagatcaagggcccggtcgccggtaccgacgcgcagctgtgggtcaagctgaatccgcaggcctaccgcgacctcgcccagcggcatctggccgggctggaaccgatctagcggccccgcgttagccggagatcttcttggtgttggcggccgcgcggtccatctcccaataggcgcgcagcgcgaccagcttgccctcgtcgtcggccttgtaggtgaacacgccctcggcggtggtctggtagtcacccgtcgtgacgaggatgtgcccgacgttggcttcctcgttgccgcactgataggtgtcgcggaagacgaactcgatcttggtggtgggcgcgatcgccttgtcccagaaggccgagatcgccgcacggccccgatgccccttgccctcggggtcgaaaaccgaagggccgatggggtcctcgacgacggcgtcgtcggcgaacaccgccagccaggcctccttgtccctggccgtcaccgcctcgcgggaccggcggccggcttcgtgcgcgggatgcacgctcagaccttctcggctgcgggcttgtcggcgccgaccacccacatcgagtagtactgcgagccgccaccgtaggcgtgtcccaacgccttccgggcgccgggcacctggtgatcgccgcccttgcccatcacctggatggccgcctcggcgaagcggatcagccccgaggcgccgatcgggttcgacgacagcacaccaccggacgggttgaccggcagccggccgccgatcttggtctcgcccgcctcggtgagcttccagccctcgccctcgggagcaaagccgaggttttccaaccacatcggctcgaaccaggagaacggcacgtagatctccgcggcatcgatctcgtcgatggggctcttgatgccggcggccttccacagcgcggcggccgcgtcacgcccggcctgcgggctgacctggtcgcgcccggcgtaggccagcggctcggtgcgcaacgccgtggcatggatccacgccaccggattgccttgcgccagacgggcttcggcggcctcctcgttaccgatcaccaccgcgcaggcaccgtccgacgacgggcaggtctcgtcgtagcggatcgggtcccacagcatcggcgactccatcaccttctccagggtgatgtcgggctgatgcaggtgcgccaacgggttacggcatccgttgagccggtccttgacggcgaccatggcgccgatgtgcgtcggtgcgccggagcggcggatgtaggcccgcacgtgcggggcgaaatagccaccggcacccgcgcccaccggcttgatgaacggaaccggaatcgacaacgcccacatggcattcgactccgactgcttctcccaggccatcgccagcacgcggcggtacttaccggactgcaccaggctggcggccaccaccccggtggagccgccgaccgacccggcggtgtgcactcggatcagcggcttgccggtggcgcccacggcgtcggccatgaacagctcgggcatcatgacgccctcgaagaagtcgggtgccttgccgaccaccacggcgtcgatgtcgccgaaggtgcaacccgagtcggccagtgcgcggtcgatggcctcgcgcaccaggccgttcatcgaaacgtcttggcgcttggccacatacttcgtttgtccggtacccagtaccgcggcgatgttcggccctgcaccggccatcagttcttcccttccatgaccgcgaccagattctgctgcagcgcgggcccgctggtggcgtgcgccagcacccgctcggccgaaccatcccagatgtgttgtgcggcaaagccgatgcgctccaggccggccacgaacatcgggttggccgccagcgcaccgccggacggattgaccttggtcggccccggtatccggatggcttcggcgatgatcaggtgctggtgggtgaacggcgcgcagatctcgaccacgtcgaggttgtcggtccgcccgccggtggcgatttcggcggcggccttggtggacggcgactcggtgaggtcacgcacgcccagcgccggggattcgatgcggtgctcgataccggtgatccaggcggggttctcgcgcagctcgcgggcccggtcgccggccgccagcacgatcgccgcggcgccgtcggtgatcggcgcgatgtcgtgacggcgcaacggctcggcgaagaacggccgttccagcagttcggctacggtgatcgagccctccacgttgtccacccggcgcgcattggcgaacgagtcgaaggccacccgcgccatctgctcctcggtccacttgccggtgtcgagccccatgcgggcctgcagcccggccatcgagatcgaatcgggccacagcggcgcgacggtgtaggggtcggtctgccgcgacaagatctggcgcagcaccccggccgaggacttgccgaagccgtacaccagcgcggtgtcgacctcgccggtcagcagcttgatgtaggcctcatacagggcccaggccgcgtccatctcgacgtgcgattcgttgatcggcggcaccgcgccgatcgagtcgatcgccgagatgaaggaaaacgcccgtccggcaaggtaatccgaggatcccgaacaccagaagccgatatcggccttggtgatgcccaggtcctggtagagctgggcgaaacacggcatcaacatctcgacgccgttggtggtgccgtcggtgcggcggacatgcggcgcgtgggcaaagccgaccaccgcaacattgcgagcgctcatttgacaggtatgccctttacaggtggtgcttgtaggtgtcgtagtcggcgtcgggttccccggtcggccggaagtactcgatgttgtcgatgccaaagccccactgctcgcggggtttccacaccgcttccacccgcatgcccatccgcacctcgtgcgcgtcgacgtcggcgaccagatgcaagaacgggatgtcggccccgtcgagcagcacgtaggccgccacgtacggcggcttgatgcgctgcccctggaacgggatgttgatgatcgcgaacgtcgtcaccgtgcccttgtcgggcagctcgacgaactccgtggtcggctggccggtggccgggtcggcgccgtgcggcgggaaatacaccttgccgttcttgccggtgcgcgcgcccagcagcttgccctgggcgatggcgcgcaggtaggcgctctcctcgtgcgaggcggtgtgctggatggtcagcgagatcggcgtgacgatcatgctcaccgggtccttgtcggcgtcgggctgctcggccaccggctcggggtcctcgcccagcgcgaaataggcgatgtcggtgatggcgcccaccggctcgtcggcccagtgcacgtgcacccgggtgccggacttgatggccttgggctcgccggcgtcgaccgcgtgcagcagcggggtgtccgcgccgtcgagcttgatcagcgcccacgcgaacggccggtccagcggctgaccttcgatcgggtcgggctgccaggcccacgagacgacggtgccgaccggcgacaccggtaccatctcgcccagcggttcgtaggtgaccgggtcatactccggcggcggcacgtgtacccggccatccgatccgcgcacacccaggacgcggcgctcacgcagtgcggtgaagaacttgctcagcgtggggccgactgaacgggtgtagtcgaacgacaacgtcaacggcgcggagagcggtggctcagggtgatccgtcaaggtcgggctactcgagctggctgtcacgccatcgagtagaacaggttctaagaacggattcaacatcgggtctactaccgaagggcgaagaccatgaagctgggactgcagctgggatattgggccgccgggccgccggaaaaccacggcgagctcgtcgccgctgccgaggaagccgggtatgactccgtcttcaccgccgaggcgtggggatccgacgcctacaccccgctggcctggtggggctcgtcgacgtcgcgggtgcggctgggcacctcggtggtccagctgtccgcccggaccccgacggcctgcgcgatggcggcgctgacgctggaccacctctccggcggccggcacatcctgggcctgggcgtgtccggcccgcaggtggttgagggctggtacggacagcggttccccaagccgctggcccgcacccgcgaatacatcgacatcatccggcaggtgtgggcccgggagaagccggtgaccagcgacggcccccactatccgctgccgttgaccggcacgggcacaacgggtctgggcaaggctttgaaacccatcacgcacccgctgcgcgccgacatcccgatcttcctgggtgccgaggggccgaggaacgtcgcgctggccgccgagatctgcgacggctggctgccgatcttctacaccccgcggctggccgacatgtacaacgaatggctggacgagggattcgcccggccgggcgcgcgccgcagccgcgcggacttcgagatctgcgcgaccgccaacatcgtcatcaccgaggaccgcggcgcggcgttcgccgcgatgaagccctacatcgcgctctacatgggcgggatgggcgcggaggacaccaacttccacgccgacgtctaccgccggatgggctacgccgaggtcgtcgacgaggtgaccaggctgttccgcagcggacgcaaggacgaggccgccaagatcatccccgacgaggtgatcgacgacgccgcgatcgtcggcgacgtcgactacgtgcgtaagcagatcaaggcctgggaggccgccggcgtcaccatgatggtggtgtccgggcgcagtacagagcaggtccgcgagctggccacgctgatctgaacccggcgcaccaccaactagaacacgttctagttttcttgccagtggcctagaacacgttctagattggccggatggcaggcccgacgacgatgcagtcagcccagcgggtgggcgtcgccgaaggtcatctcgacgtggccgaccgatccggagatcatcgcgcgcgtcggcaggcccagcgacgccagctcctgggcgtaggggtgggtgcccagccgcaaggtggccccgccgggccggccgcgcagcccgcgcacccgcatctcccagggcacctcccgggtggtgccttcggcgaaggtgtaggtcttgagcacctgcggccgcgacgtgaacagcgacggcaccggcaatccgggcgcgaagtcgatgccggcgatgtgcgcgccgtcggcgctgacgtcgaacccgaagcggccttgttcgcgaacggtgaagtccgccatgatcttcgggaatccccagatcgagcgtccggcctccagggtgaagctctggtcgacgggcaggtgatggatgaaggcggccgcctcgcccagcgcccgccagccgcgcgccgtcgagccgggcgggttgaccatcacgcaggtgccgaattcgtggtactggcccaggtcgccgtcgatgtagcgggccagcatcaggttgaccaccgcccggccgggccggtgctggcagaccttcaggccgctgtagtcgataagccgttgtgccgcttgcgcatccaccgaaaacatcgcggtgtggacgtccgcttttcggatccgcaccggcatggtgaggactgtccccgcaacgatgtgttgtgactcggtcatgccggttactgtaatcctttcgtcaacatttggaggctgtagatgacttcgaccatcccggaagcgatcgcgaacatcgatctggccgacggaaatttctacgccgaccggcgcgcgtcgcgcgaggcgtatcgctggatgcgcgccaaccagccggtgttccgggatcgcaacgggttggccggcgccaccacctatcaggccatccaagacgccgagcgcaatccggagctgttctcttccaccggcggcatccgtcccgaccagcccggcatgccctacatgatcgacatggacgatcccgcacatctgttgcggcgcaagctcgtcaacgccggcttcacccgcaagcgggtgaaggagaaggagccgtccatcggcacgttgtgcgacaccctgatcgacgcggtgtgtgagcgcggcgaatgtgacttcgtccgcgacatcgccgccccgctgccgatggcggtgatcggcgacatgctgggcgtgctgcccaccgaacgcggcatgctgctgaagtggtccgacgacctggtgtgcggcctgagttcgcacatcgaccccacgtcggccgaattccaaacggtgatggacgctttcgccgcctacaccgccttcaccatggacatcatcgccaagcggcgggccgagcccaccgacgacctgttctccatcctggtgaacgccgaggtcgaggggcagcggatgtccgacgacgagatcgtcatggagacgctgctgatcctgatcggtggcgacgagaccacccggcacacgctgtccggcggcaccgaacagctgctgcgccaccgcgaccagtgggacgcgctggtgcgcgacccgtcgctgctgccgggcgccatcgaggagatgctgcgctggacgtcgccggtcaagaacatgtgccgcaccctgaccgccgacaccgaattccacggcaccgagctgcgggccggggagaagatcatgctgctgttcgagtcgggcaacttcgacgagtcggtgttcgacgacccggacagcttcgacatccggcgaaacccgaacagccacatggcgttcggcttcggcactcacttctgcctgggcaaccagctggcccgtctcgagctgtcgatgatgaccgagcgggtgctcaagcggctgccggacctgcggctggccgacgacggcgatctgccgctgcgcccggcgaacttcgtcagcggtctggaggcgatgccggtggtgttcaccccgagcgcgccgctgctgcgctgagcgggctccgtgggctgcgctagatccgctagctccgctggctccgcgggctgggtcggctgcgcgagctccgctggctccgcgagctccgctggcttcccgagcgccgctccttcccgagcgtgtactcaccgcgaatttccggccggtttttcgctgccagtgcacgttcggcgcgtccaggccgtcgacacccgggcgatgatgccggcgggcgtgtcctcggccgtgacccggacgaccgtccaccccaactcggcgagaacctccgcgcgccgaatgtccttggtgaattgtcttcggtcggtgcggtgttggtcgccgtcgtactcgaccgccagtttgatgtcctcccagcccatgtcgagacaggcgatcagcgcaccgtattggcggaccggtagctgcgtgcgcggccgcgggaaacccgcgcggagcaggagaagccgcagccacgtttcccggggagactccgcgcccgcgtcgacaagcggcagcacgctgcggccacgggtgatgccgcggcggccccggtagcgatcggcgagcaactcgatttccaacaccttcagctcggttgcgcgcgccagcgcgtcgatcgcggcgacggccttgtcgacgggggagcggcaggcgatgtcgagagccgtccgtgcgggcgtcgtcaccggcatgcctccgatcgtctggatttcgtcaccgaccagccggtccgaccacgtctggatgccatccggcgggcggcggtacgggtacagcagctgggcgggggcgcggtcgtcgatccatttcgtgccgtacagggcggccgcggatctgcccgcgacgacgccgcgccgacgagaccacaaccaggccgaccgggcgcgcagtccggcggacagcgcggtgccggccgggacgtacacgtcgggatggaccctgacgaaccggctccgcagcgcgtacggggtcaccaggccggacgcgacggcctcgcttccgatgaaaggctccgccatggcaggagtgtgccggggaaccccgacaagcgtgccgagcgtgcactgagcgcgaaaatcgggcccgaaagtcgcagtaggtgcacgttcggcgagaagaggacgccggggcgcacgccgagaggacgccggggcgcacgccaagaaggcgccccgcgcgccgagcgacccgaccgggctagcggttttggaagttgggtttgcgcttctcggcgaatgcgcgcgggccttccttggcgtcctcggacaggaacaccttgatgccgatctgcgtgtcgatcttgaacgcctcgttctcgtgcatgccctcggtctcgcggatcgctcgcaggatcgcctgcacggccagcggcccgttgttctcgatcacctcggcgatctcgagggccttggccagcgcctgcccgtcggggacgacgtgcccgatcagccccatctccttggcctcggcggcggtgatgtgccgcccggtcagcagcaggtcgcaggccaccgtgtaggggatctggcgcaccagccgcaccgccgagccgcccatcgggtacaggctccacttggcctccgagatgccgaacttggcgctctcgccggccacccggatgtcggtgccctgcaggatctcggtgccgccggcgatcgcggggccctcgacggccgcgatcaacggcttggtcagccgccggcccttcagcagggcatcgattcgcgacgggtcgtagctgccgtccttgaaggattcgcccggcggtttcttggtcgccgccttgaggtccatgccggcgcagaagtagccaccggcgccggtcaggatgcagcagcggatgtcgtcgtcgttgtcgacgcggtcccaggcctgcaccatgatctccatcatttcggtgctcagcgcgttgcgcgcgtgcggccggtttagcgtcacgatgagggtgtgaccgcgctgctcgaccagcgcgtcgggaccggttttttcgtttgctgacgcctcggccacgggtaccgcctctcactcgacatcgggcatgagcttgcctcgaaatgtaacacgttctaatttggtggccgtggccctgaatattgccgatctcgcagagcacgccatcgacgctgtgcccgaccgtgtcgccctgatctgcggcgacgagaagctgacctatgccgagctggaggagaaggccaaccgcctcgcccactacctgctcgaccagggggtgaagaaggacgacaaggtcgggctgtactgccgcaaccgcaacgagatcgtcatcgccatgctcggcatcgtcaaggcaggcgccatcctggtcaacgtcaactaccgctacgtcgagggcgagctgcgctacctgttcgacaactccgacatggtggcgctggtccacgagcgccagcactccgaccgggtggccaacgtgctgcccgacacccccaacgtcaagaccatcctggtggtcgaggacggcagcgacaaggactaccagcgctacggcggcgtcgagttctactcggcgctggaaaagggctcgcccgagcgggatttcggcccgcgcagcgccgacgacatctacctgctctacaccggcggcaccaccgggttcccgaagggcgtgatgtggcgccacgaggacatctaccgggtgctgttcggcggaaccgacttcgccacaggcgaattcgtcaaggacgagtacgacctggccaaggccgccgccgaaaatccgccgatgatccgctacccgatcccgccgatgatccacggcgccacccagtcggccacctggatgtcgatcttctccggccaaaccacggtgctggcaccggaattcaacgccgacgaggtgtggcgcaccatccacgagcacaaggtcaacctgctgttcttcaccggcgacgcgatggcccgcccgctgctggacgcgttgaacaaggaccacgactacgacctgtcgtcgctgttcctgctggccagcaccgcggccctgttctcgccgagcatcaaggagcgcctgctcgagttgctgcccaaccgggtcatcaccgactcgatcggctcctcggagaccgggttcggcggcaccagcatcgtcgccaaggacgcgccgcacgccggcgggccgcgggtgacgatcgaccaccgcaccgtggtgctcgacgaggagggcaacgaggtcaagccgggctccggtgtgcgcgggctgatcgccaagaagggcaacatcccggtcggctactacaaggacgagaagaagaccgccgagacgttcaagacgttcaacggcgtgcgctacgccatccccggcgactacgcactggtcgaggaggacggcacggtcaccatgctgggccgcggctcggtgtcgatcaacagcggcggcgagaagatctaccccgaagaggtcgagggcgcgctcaaggggcatcccgacgtgttcgacgcgctggtggtcggcgtgcccgatccgcggtacggccagcacgtggccgccgtggtgcagccccggccggggacccggccgtcgctggccgagttggaccgcttcgtgcgttcggagatcgcgggatacaaagtgccgcgtagtctttggctggtcgatgaggtgaagcggtcgccggcgggcaagcccgactaccgctgggccaaggagcagaccgaggcccgcccggccgacgacgtgcacgccgcccacgtctccgcctgatccggctgggtgaccgatttcgtcaagcagcacccccggtcgcccgagggcttcttcgggtgggaggccgccgggttgcgctggctgtcgagcgtcgacggcggcgtgccctgcgcccgggtgttggcggtcgacgcgaccagcctgaccctgcggcggctgcagtcggtgcccgccggccgggacgcggcgcacgagttcggccgccggctggccgtcacgcatgacgccggcgcggccgcgttcggggcgggccccgacggatgggacgggccgggatacttcgggccgctgtcgcagccgttgccgatgtcgctgcggcggcaccggcattggggcagcttctacgccgaggagcggctggtgccgatggccgagcgcgccgcgccgaggctggcggcctccacccgcgacgcgatcggcgccgtggcggcccgctgccgggccggtgacttcgacgacgacgacggtcccgcccggctgcacggcgacctgtggagcggcaacgtgatgtggacgcccgacggcgtggtgttgatcgacccggccgcccacggcgggcaccgcgaaaccgacctggcgatgctggcgctgttcggctgcccgcactacgacgccgtgctggccggctaccaacaggtgcgagcgctgaaaccgggctggcgcaaccggattgggctgcaccagctctatccgctgctggcgcacgtggtgctgttcggcggcggctacgcgggccagacggacgccgcggcccgcgccgcgctggccgcatgacccgggtctagagtctggtcgcatgacgatcgatgtgtggatgcagcatcccaccgtcaggttcctgcgcagcgacatgctggcctcgctgcggcgctggaccggcgggtcgatccccgacaccgacatccccatcgaggcgaccctggcatcgatggacgccgccggcgtgcgctacgggctgctcagcgcctggcgcggtcccaacgggcaggatctggtgtccaacgacgaggtggcgcaatgggttgccgcgcacccgaatcggttcgccggcctggccgccgtcgacctggaccgcccgatggaagccgtccgcgagctgcgacgccggatcgccgacggcggattcgtcggcctgcgggtggtgccgtggctgtggaacgccccgcccaccgatcgccgctactacccgctgttcgccgcgtgcgtggaggccggggtgccgttctgcacccaggtcgggcacaccggcccgctgcggccgtcggagaccggccgcccgattccctacatcgaccaggtggccctggacttcccggagctggtgatcgtctgcggccacgtcggctacccgtggaccgaggagatggtcgcggtggcccgcaagcacgagaacgtctacatcgacacctcggcctacaccatcgagcggttgccggacgaactcgtcaggttcatcaaaaccgggaccgggcagcgaaaagtgttgttcggcaccaactatccgatgatcaccgccgagcacgcgctggcgggactggacggactcgggctgtccgacgaggcccggcgggatttcctgcacggcaatgccgagcgggtgttcagactggaggcagccacgtgaacggtgctcaggcgctgatccggaccctggtcgacggcggcgtcgacgtgtgtttcgccaacccgggcacgtcggaaatgcacttcgtcgcggcgctggacagcgttccgcggatgcgcggcgtgctggcgctgttcgagggcgtggccaccggcgcggccgacgggtacgcccgcatcgccgatcggccggccgcggtgctgctgcatctgggccccgggttgggcaacgggctggccaacctgcacaacgcccgccgcgcgcgggtgccgatggtggtggtcgtcggtgaccacgccacctaccacaaaaagtacgacgccccactggaatccgacatcgacgccctcgccggcagcgtgtcgggatgggtgcgccggaccagcgacgcctcccaggtttcggccgacgccgtcgagggcatcgccgccagccggtggggatcgcagatctccacgctgatcctgcccgccgacgtgtcttggtccgacggcgcgcagctgttctccaccatggacgcgcggccggcgggtgccgacccgctgctggcgccggaggtggtcgaggtactgcgctcgggggagccgacggtgatcctggtgggcggcgacgctacccgccgcgccgggctggccgcggccgcccggatcgccgcggccaccggcgcccgggtgctgtgcgaaaccttccccacccggctggagcgcggcgccggcatccccgccgtcgagcggctcgcctatttcgccgaagccgccgccgcccagctggacggcgccaagcatctggtgttggccggcgccaagtcgccggtgtcgttcttcgcctacccgggcatgccgagcgatctggtgcccgccggttgcgaggtgcacgtcctcgccgggcacaccggcgcggcggatgcgttgagcgccttggcggatcagctcgcgcccgggacggcggcgccggtggcggcggcgtcgcgcccggccttgccgacgggcccgctgacgtcggcgtcggcggccgacgtgatcggggcgctgctgccggaacgggcgatcgtcgtcgacgagtcgaacacctccggcgtgctgctggcacaggcgaccgccagcgcgccggcgcacgactggctgaccctgaccggcggggcgatcggctacggcattccggccgcggtcggtgccgccgtcgccgccccggatcgtccggtgctctgcctggaatccgacggctcggcgatgtacacgatctcgggatagtggacccaggcccgggagaacctcaacgtgaccaccgtgctgtacgacaacagtgcctacgacatcctgcgcatcgagctgcaacgcgtcggcgccggatcggcccccgggcccgaagcgctttccctgctcgatttgtcggatcccgcaatggatttcgtgaagatcagcgaaggcatgggcgtgccggcccggcgggtcagcaccgcggaggaattcgccgacgcgctgcgcgccgccctcgccgaaccggggccgcacctgatcgatgccgtggtgccctcaatagcgggctaggctcggcagccggctgagcagccagtcggtcaacgtgtcgagcacgtcgacgccggtctcgaacacgccgtcgtgggtatccgccgccagcgccaccccccagtttcccgtcggggtggggacgacgccgaactgccggaccaggtattcatcgcggccgccggggccccaaccccccttggcggcaagccctttggcggccagcccccaccgctgggtaggactgaggcgctgcatcatgtcgatcacctcggccgcgtccgggatggtcgacagctccgcggcgaaccgcgcctggcgctgcaggctccactgggtctgaccgaaggcggtgaagccacggcgaagccggcgggactccaccaccgtcgcggtgtcgccgccctcggccaccacggcctggacctgccgcgccgcctcggccggctcgcccagttgcgaccacaactgctcggaggcgcggttgtcggattcggtgacggccttggtggccaattcgcgggcacccagccagtccttgcgcagggccgcgatcgccagcggcaccttgatcgtcgaccacgccacccccgaccaccagctgcccagggagaacgtgcggtccgggcgggcgacggccaccccgaccttcgccggcaccgtcgcggcaagctggtcgaagctggcctcgagcgccagttcgagaggacgtgaagtcatgcgccgcttccggtgtcggcgcgcgtgacgatgccgccggagcatggggccggcgcagcaaccatcgcgtctcctcgtgtcggcggcacgttcatgcagtgtcgcacagcgcggccgccggcgaccgctagcccgacggcggcggcgggagctcggcggcgggaggagcttccggcggttcggattccggcgtcggcggcgcccataccagcggcgggggcggcggcatcggaggcggcgggggcgggtcggccgcggcgcggccggcgcccggcccgaggccgccggccagcgacccgaccagcagcgaaccggcgatgagcttgtgcaccttcgtcatccgttcgagccctttctcgttgcggccgaagcgtattcggcgccgccgcgtcagcggccgatcttccacaccgggtcaccgcagtcgacgccctgggcggccaactgccgcttgagcaccttgaaggtgaccgtccgcgggagttcggtgctgatccgcacgtacgacggccactgcttgggccccaggtcgggttgttcggccaggaaggcgcggaacttctcgtcgtcgaactcggcgcccggtgcgagcaccagcgcggccatcacctggtcgccgaccgtcgggtccggcaccgggtacaccgccacctcggtgacgtcgggatggcgcagcagcacccgctcgatgggtgcggcgcccaggttttcgccgtcgacccgcatccaatcaccaaggcgcccagcgaaatacgcgtagccggcctcgtcgcggtacgcgagatcgccgctgtggtacaccccgccggccatccgttcggcctcggcggcctcgtcggtgtagtaaccctcgaaacgccccggcccggcggtgttcaccagctcgccgaccacccccggggggcaggacgcgccggtatcgggatcgacgatgtcgatacccgccggcaacgggcccagcgagccgggcggcgtgtcgggggtgcgggcgatggccacaccgccctcggtggagccgaacccgtcctgcacgacgcacccgaaccggcgggcgaagcgctcgatgtcggcgggcacgccctcgttgccgtacaccgcgcgcagcgggttctgggcgtcgtcgggccgctccggcgtggccagcacgtaggacagcggcttgcccacgtagttcgcgtaggtggccccgtagcggcgcacgtccggcaaaaatcccgaggcactgaacttgcgccgcaacgccattgagccctggcaggccgcggccaccgcccagccgaccagcaccgcgttggaatggaacagcggcatcgacacgtagcagacgtcgtcgcggcccaggccgaagcgctgcgtcatggtcacgccggcgatggcgaccttgccgtgactgcacttgaccgccttcggctcgccgctggtgcccgaggtgaagatcagcatgaacaggtcggccggcgaggcggatcgaaaaacgatcggcgcgccgcggtgcgcggccacctcgtcggcccatgcggcggagtcgacgttcaggtgctcgatatcgcccagcgtcccggccgaattcgcgtcggccagcaccagttggcagtcggccctggcgatgtcgcgccgcagcgcatcgccgcggcgcaccgggttgagccccaccggcacgatccccgacattccggccgccaccagcaccgccgagaagaacggggtgttctccaggagcacgccgacgtgcggcgggcgggccgggtcgagccgcgcccgcaacgccgcggcgatcgcggcaccgtgctgcaggtgatcgcgccagctggtgaacgagtcctcgaagtagacaccccgatcgtcgatctcggtcagcggcaccagcagttcggtgaccgtcagatcgtcgctgagttccattgcgcctaggcgggcgtctccgccaactcgcggccgatccggcgcagctgcccggtggcgccgcccagcgcgaactcggcctgtttggcggccaggaagtagcggtgcaccgggtgatcggtgtcgacgccgacaccgccgtgcacgtgcacgatggtgtgcgccacccgatgcccggcgtcggcggcccagaacgccgcggtggcgacgtcgacctcggccggcaggtcctccgagacccgctaggcggcctgggtgagcgtcaggcgcaagcccttgacgtcgatgtagccgtcggccagccgctgcgacaccgcctggaagctgccgatcgggcggtcgaattgctcacgggtgcgggcgtattcggccgtcatctgcaggccgcgctcgagcaccccgagctggaaagcggcccgccccaaggtgcccagcgtgcccagccaggccgcgacctcggcgcctccgacctggcgggtgccgtccagctgggtcccgtccagcgccagatgcccgacgctgcccaggccggtggtctccagcgcggtcaccgtgacgccgggatcgtcggcggcaaccaggaaaaccgctgtcccggaatcagtttcggccggaaccaggaaggcgtcggcgacggggccgaagccgacctgggtgcgggtgccggtcagccggtagccggcgccggcgctgaccgcctgcaccggtccctcgcccatctccgggtcgagggcgacggtcagcgtcttttcgccgctgaccgccggcacgccccagccctgctgcagctcctcggtgccgaaccgggccagcgccccggcgcccagcaccaccgactccaggtagggcaccgcggccagctggtgacccagtgccaccaggatcgcgatctgctcgagcgcgccgaagccgtcgccgcccagcgatgtcgccgacgcgctggacaggatgccggcgtcgatcagcttggcccacaggtcgcggtcgaagcgctgttcgaggccgtcgagctcgcgttggtgttcgggtgtgcagaccgagtccacgatggtgtcgaccaggttgccgagatcgtgcgccgcttcggtggtggtgaagtccatgaacgtccgtccttgtctgcagatgcggctcagcggttgcggggcagtcccagcgcgaccatgccgatgatgtcgcgctgcacctcgttggtgccgccgccgaaggtcaggatcaaacacgcccggtgcatccgctccacccggccgcgcagcagggcgccgggcgagtcctgacggacggtggccgcggtacccagcacctccatcagcagccggtaggcctcggtggccagctcggtgccgtacaccttggccgccgaggcgtcggccggccccagggcgtggccgtcggaggaggccagctcccagttgatcagcttgagcacctcggccttggcgtgcacccgggccaggttgatctgcacccactcggagtcgatgagccgggcgccgctggcgtccttggtgttctgcgcccattcccgcacctcgcgcagcgccaaatagatcggcgccggcgagaccagcgcgacgcgctcgtggttgagctggttggtcaccagcttccagccgccgttctcctcgccgaccaggttggtcaccggcacccgcacgtcggagtaataggtggcgctggtgtcggggccggccatggtgtgcaccggcgtccaggagaaaccctccgcggtggtgggcaccaccagcatcgagatgccgcggtgcttcttggcctcggggttggtgcgcaccgccagccacacccagtcggcgtaggcgatcaggctggtccacatcttctggccgttgatcacatagtcgtcgccgtcgcgcaccgcggtggtgcgcaggttggccaggtcggtgccggcgcccggttcggagtagccgatggagaagtgcagctcgcccgcggcgatcttgggcaggaagtacttcttctgctcgtcggtgccgaacgccatgatcgtcggcgccacgctgttgatcgtcaggaacggcaccggcgcgccggcgatggcggcctcgtcggtgaagatcagcgagtccatcggggagcggtcctggccgccgtactccttgggccagttcagggtcagccagccgtccttgcccatctgggcgacggtttcgcgatagacgttgccgaccccgtattcgccctgcgtcgagctcagcgcctcgcggcgctcgggcgtcatcagcttggtgaagtacgacctcagctcgcgacgcaggtcctcctgctccggggtataactgatgcgcatttcggccgtccttgaggtcaacgtcgttcggagtgacaagccacgtcgcgtgttgcggctcgaccaacggctacccgttcgtcttcccggttgtaacacgttctagtctgggaatccagcgaccgtttccccagaggtgtcggggtcctatggtggacctacatactgatgagacgtgtcctcagttcgaaggccaggttcaaggagggtgctgtgcgggtgatcgtggaccgtgaccggtgcgaaggtaacgcagtgtgcttgggaattgccccagatatcttcgacctcgacgacgaggactacgccgtggtgaagctggacccgattcccgccgatcaggagcagttggccgagcaggcgatcgccgaatgcccgcgcgcggcgctgtcgcgcggcgactgaaccgggcggaacacagaaactagaggtattcataaattgactagcagcacgaacgcgaccgatctgtccggaaaggtcgcggtggtgaccggtgcggccgcgggcctgggacgcgccgaggcgctcgggctggcacgcctgggcgcgaccgtcgtcgtcaacgacatcgccaccgcgctggacgcctccgacgtcatcgacgagatcaacgccgccggctccaaggccgtcgcggtggccggcgacatcagcgaacgcgccaccgccgacgaattggttgctcaggccgacgggctgggcgggctggacatcgtggtgaacaacgccggcatcacccgcgaccggatgctgttcaacatgtccgacgaggagtgggacctggtcatcgccgtgcacctgcgcggccacttcctgctgacccgcaacgccgccgcctactggcgctcgagggccaaggaggccggcggccggatcttcggccgcatcgtcaacaccgcgtcggaggccggcctggtcggcccggtcgggcaggcgaactacggcgccgccaaggccggcatcatctcgctgaccctgacggccgcccgcgcgctgggccgctacggcgtgtgcgccaacgcgatctgcccccgggcgcgcaccgcgatgacggccgacgtgttcggcgatgcgcccgaggtcccggccggcggggtcgacccgctgtcgcccgagcatgtggtcaacctggtcacgttcctgtcgtcgccggccgccgccgaagtgaacgggcaggtgttcatcgtctacggtccacaggtgacacttgtcgctgcgccgaccgccgagcacaaattcagcgcgcaaggccccgcgtgggaccccgccgaactcagcgcgacgttgcaggattactttgctggacgtgatcccgagcacaatttttcggcgagcgcactgatggagcaatagctgggggcagctaatcggcggggggaaatcagcaggtagaacgtgtgtcagtttgacacgtgacaagtgcgtctgacctgctgaattaacggttgggataaagaaatgctgttcattgacatggtgaacttgttctgagttaatatgatccggctcacacgggcccgggtgcgaacctaaacgacgcaaaggccagccatagacttcgccgagacctatcgaggggggaactcaagttgatcgaacaacttgcggtccccgcccgcgccgtcggcggtttcttcgaaatgatgatcgataccggccgggcggcgtttcgccggccgttccagttcggcgagttcttggatcagacgtggatgatcgcccgggtgtcgctggtgcccacgctgttggtgtcgatcccgttcacggtgttggtggcgttcaccttgaacatcctgctgcgcgagatcggcgcggccgacctctcgggggccggcacggcgttcggcaccatcacccagctgggtccggtggtgacggtgctggtggtggccggcgcgggtgcgacggcgatctgcgcggatctgggtgcgcgcaccatccgcgaggagatcgacgcgatgcgggtgctgggcatcgacccgatccaccggctggtggtgccccgggtgctggcgtcgacggtggtggcgttgctgctcaacggattggtctgtgccatcgggctttccggtgggtatgtgttctcggtctttctgcagggcgtcaacccgggtgcgttcatcaacgggctgacggtgctgaccggtctgcgtgaattggtgctggccgaggtcaaggcactgctgttcggggtgatggccgggatggtgggctgttatcgcgggctgaccgtcaagggcgggcccaagggggtgggcaacgcggtcaacgagaccgttgtctatgcgttcatttgtctgttcgtgatcaatgtggtgatgaccgccatcggcgtgcgaatctcggcgaagtgatgggacgggtgggcacgccatgagttatgacgccacgctgcgatttcggcggtggttctcgcggctgcaggaaccggtcgacgacttcggcgagcaggcgctgttctacgggcagaccatgcgctacgtgcccaacgcgctcacccggtaccgcaaggagacgatccggctgatcgccgagatgaccatgggcgcaggcgctttggtgatgatcggcggcacggtgggggtggcggcgtttttgaccctggcctcgggcggggtgatcgccgtgcaggggtattcgtcgctgggcaacatcggcatcgaggcgctgaccgggttcttgtcggccttcctgaacgtgcgggtggtcgcgccggtgatcgccggcatcgcgctggcggccaccatcggcgccggcgccaccgcgcagttgggggcgatgcgggtctccgaggagatcgacgccgtcgagtgcatggcggtgcactcggtgtcctacctggtctccacccggctgatcgccggcctgatcgcgatcgttccgctgtactccctgtcggtgctggccgcgttcttcgccgcccgcttcaccaccgtctacatcaacgggcagtcaaagggcctctatgaccactacttcaacaccttcctgatcccctcggacctgctgtggtcgttcctgcaggccatcgtgatgtccatcgcggtcatgctggtgcacacctattacggctacaacgcgcacggcggcccggtcggcgtgggcatcgccgtcggccaggccgtgcgcacctcgctgatcgtcgtggtcgtcatcactttgttcatctcgctcgccgtctacggggtatcgggtaacttcaacctctccggataagagaaccgcttaacaagggacatggcagacacaggagcgcgacgcaccaccgtccggctggccgcagcagtgctggccggcctgatggtggctttcgctgtgctgacctatctttcgtacacggcggccttcgcgccgatcgacaccgtcaccgtgtccgcgccccgcgccgggctggtgatggagcagggcgccaaggtcaaataccgcggcatccagatcggcaaggtcgaggccatcgagtactccggcgaccaggcgcggctgacgctgggcatcaacagcaaggacatgcatttcatcccgtccaacgccaccgtgcacatcgccggtaacaccatcttcggcgccaaggcgggtggaattcattccgccgcaaacaccttcgccgacctccctgcgcccggacgcccacgtcgcggccacctcggtgcagctggaggtcaataccttgttccagtcgctgatcgacctgctgcacaagatcgacccggtcgaactcaacggaacgctgagcgcgttctccgaaggcctgcgcggccacggtgacgacctgggcggcatcctgtcggggctgaatacgctgacccgccaagcgaatccgaagctgccggcgttgcaggaggacttccgcaagaccgcggtcgtcagcaacgtctacgccgacgccgcgccagacctgaacaccgtcttcgacaacctgcccacgatcaacaagaccgtggtggaccagcagaagaacctcgacaccacgctgctggccaccatcggcctggcgaacaacgcctatgacacgttggccccggccgagcaggacttcatcgacaccatcaaccgggtgcgggccccgctgaaggtggccgccgactattcaccggaattcggttgcctgttcgccggcatcgagcgcggcatcaaggaattcgccccgctgctcggcgtccgcaaggcgggcctgttcacctcgtccagcttcgtgctgggcgcgccgtcgtacacctatcccgaatcgctgccgatcgtcaacgcctccggcgggccgaactgccgtgggctgccggacatcccgaccaagcagaccggcggctcgttctaccgggcgccgttcctggtcaccgacaacgccaacatcccgtacgagccgttcaccgaactgcaggtcgacgcgccctccacgctgcagttcttgttccacggcgccttcgcggaacgggacgacttctaatggccggctcgggaatgccctcgcaccgctcgatgatgatcaaggtcagcatcttcgcggcggccatgctgttggtgtcggccggactggtggtggtcttcggcgacttccggttcggccccgaaagcacttaccacgcaacgtttgtcgacgtgtcccggttgaaggccggccagaaggtgtgcatcgccggtgtaccggtcggtgcggtggaggccgtgaagctcaaccgggacaacaccatcgacgtgaccttcggcgtggacaagcgctacaccctgtattcgtccacccgcgcggtgatccgctacgaaaacctggtcggcgaccggtatctggagatcacgtcgggccccggcgagctgcgcaagctgccggcgggcgggaccatcaacagccagcacacccagcccgcactggatctcgacgcgttgctgggcggactgcggccggtgctcaagggcctggacgccgacaaggtcaacaccatcagcagcgcggtcatccagctgctgcagggccagggcggggcgttgtccaacgtgctggccgacaccagcgcgttcacctcggcgctgggccagcgcgatcagctcatcggtgacgtgatcaacaacctcaacacggtgctgaccaccgtcgaccagcgcagcgcacagttctcggccagcgtcgaccagttgcagcagttgatcaccgggctggccaagcacaaggacgacattgcgggagccatcccgccgttggcctcgacgacgacggatctgactgagctgctgcagaattcgcgccggccgctgcagggcgtactggagaacacccgcccgctggccaccgagctggacaaccgcaaggccgaggtgaacaacgacgtcgagcagctgggcgaggactatctgcggctggccgcactcggcgcctatggttcgttcttcaacatctacttctgttccgtgacgatcaagatcaacggcccggccggtagcgacatcttgctgccgctcggcggccaggtggatcccagcaaggggaggtgcgcttttgtcaagtaacgcaccgcgtgagcgcgatccactgcgcaccggcatcttcggtgtggtgctggtggtgtgcgtcgtgctcatcgcgttcggttacgccggattgccgttctggccacagggcaagatctacgacgcctacttcaccgacgccggcggcatcaatcccggtaacgccgtgtacgtttcgggcctcaaggtcggcaaggtgaccgacgtcggcctggccggcgacagcgccaagatcagcttcagcgtcgaccggcacgtggccgtcggcgaccagtcgctagccgccatccgcaccgacaccatcctcggcgaacgctccatcgcggtgaccccggccggcggcggcaaggccaccaccatcccgctgagccggaccacgaccccctacacgctggccggtgcgctcgaggacttgggatccaacgccagcaacctgaacaagccccagttcgagcaggcgctgcacgtgctgaccgacaccctgcacgacgccaccccggagctgcgcggcgcgctggacggtgtgacctcgctgtcgcgcaccctggaccgccgcgacgaggcgctgcaaagcctgctggcgcacgcgaagtcggtcaccggtgtgctgtcccagcgcgccgaacaggtcaacaagctggtcgacgacggcaacgagttgttcgccgcgctcgacgagcggcgggccgccctcggccggctgatctcggggattcaaggcctgtcggcgcagatctcgggcttcgtcgccgacaaccgcaaggaattcggcccggcgctgaacaagctcaacgacgtgctggccaacctcaacgagcgacgcgactacatcaccgaggccctcaagcggctgcccacctacgccaccgagctgggcgaggtggtcggctccggtcccgggttcaacgtgaacgtctacggtgtcatcccggcgccgctgctggcgacgatgttcgacttcttctatcagccgggcaagatgccggccagcctggccgactacctgcgcggcctgattcaggaacgctggatcatcaggccgaagtcaccatgatgcagcggttggccggcagcagggggctgcgctacaccaccatcatcgcgctggtcgcggtgttggtgggtggcgtgtatgtgctgacgtcgcaagcgaaaacccgcaagatcgtcggctacttcacctcggcggtcgggttgtatcccggcgaccaggtgcgcgtcctcggcgtcccggtcggcaccatcgacacgatcgacccgcggcccaccgacgtcaagatcaccatgtcggtgtcccaggacgtcaaggtgcccaaggacgccaaggccatcatcatgtcgccaaacctggtggcggccaggttcattcagttgacgccggcctacaccggggggccggcgctggccgacggcgccagcatcggcctggaccgcaccgccgtcccggtggagtgggacgaggtcaaacagtcgctgacccagctggccgtccaactcggaccgacggccggatcgatgcagggaccgttgggcgcggcgatcaaccaggccgcggacaccttcgacgacaagggcgagtcgttccacagcgcgctgcgtgaactctcgcaagctgctgggcggcttggggattcgcgcggcgacatcttcggcacggtgaagaacctgcagatactggtcaacgcgctgtcgtccagcaacgaacaaatcgtccagttcgccggcaacgtcgcctcggtgtcgcaggtgctcgccgacagctcgcggcacctggacaccaccctgggcaccctgaacaaggcgctgtcggacatccgcgggttcctgcacgagaacaactcgaccatcgtcgatacggtcaacaacctcaacgacttcgccaagacgctcagcgaccagagcgacaacatcgagcaggtgctgcacgtcgcgggtccgggtatcgccaacttctacaacatctacgaccccgcgcagggcacgctcaacgggctgctgtccatcccggaattcgccaacccggttcagttcatctgcggtgggtccttcgagacggccggcggcccccgggcgccggactactacaagcgcgccgaactgtgccgcgagcggttggggccggtgctgcgccggctcacggtgaactatccgccgctgatgttccacccgctcaacacgatcaccgcctacaaggggcagatcatctacgacaccccggagacccaggccaagtcagcgaccccggtgccgcagctgacctggattcccgccaagggcgcccagaccccgccggccgcgcagaacccggcggacctgcaggccctgctggtgccgacggccccgcaatccggtccggcgccggccggcggcgctccagccccgggccccgccccgggcagcgcgttcggcccgcggcccggcccgcccccgggccaggcgcccggcgggctgggcgccgacttgggcggtggcggatgagccgaatgtggttgcgcgccggcggattagcgacgggcagcatgctgctggccggctgccagttcggcgggctgaactcgctggcgatgcccggcaccgccggtcacggcagcggcgcctactcgatcaccgtcgaactgccggacgtggcgacgctgccgcagaactccccggtgatggtggacgacgtcaccgtcggcagcgtcgccggtatttcagccgaacagcgctccgacggatcgttctatgcggcagtgaaattggcgctggacaagaacgtggtgctgccggccaactcgaccgcgacggtcgcccagacctcgctgctcggctcgatgcacatcgacctgaaccgccccaaggacaggccggccgtcggccggctgaccgacgggtcgaagatcgccgaggccaacaccggtcgctaccccaccaccgaagaggtgctctcggcgctcggtgtcgtggtgaacaagggcaatgtcggtgcgctggaagagatcaccgacgagacctaccgggccgtcgcgggccgccaggaccagttcgtcgacctggtgcccaggctggccgagctgacctcgggcctcaaccgtcaggtgaacgacatcatcgacgcggtcgacggattgaaccggttctcggcgagcctggcccgcgacaaggacaacctggggcgggcgctggacacgctgcccgaggcgatccgggtgctcaacaagaaccgggaccacatcgtcgaggcgttcagcgcgctgcacaagctggccgacgtcacctcgcacatcctggccaagaccaaggtggacttcgccgccgacctcaaggacctgtacgccgccgtcaaggccctcaacgacaaccgccgcaatttcgtcacctcgctgcagttgttgctgaccttcccgttccccaacttcggcatcaagcaggcggtgcgcggtgactacctcaacgtgttcaccaccttcgacctcaccttgcgccggctcggcgaaaccttcttcaccacggcgtatttcgacccgaacatggcccacatgaacgagatcctcaacccgcccgacttcctggtcggcgagatggccaacctgtccggacaggcggccgacccgttcaagattccgcccggcacggcttcgggacagtaaggggcggacgcaatgcatgacagactgaccaagatccagctggcgatcttcgccgtcatcacggtcatcacgctgaccgtcatggcggtcttctacctgcggctgcccgccacgttcggcatcggaacctacggtgtgagcgccgatttcgtggccggcggtggcctgtacaagaacgccaacgtcacctaccgcggcgtggccgtgggccgggtcgagtcggtggggctgagccccaacggcgtgatcgcgcagatgcggctcaacagcgagacggccatcccgtcgaacgtcaccgccaccgtcaagagcgtgtcggcggtgggcgagcagtacatcgacctggtgcccccgagcgcgccggcatcgaccaagctgcgcaacggatctcgcatcgagcggcagaacacccggatcggccaggatgtggccgagctgttgcggcggtccgagacgctggtcaacagcctgggcgacacccggctgcgggagctgctgcacgagacgttcatcgcggccaacggctcgggccccgagctggcccggctgttcgagtcggcccggctgctggtggacgaggccaacgccaactatccgcaggtgtcgcagttgatcgatcaggccggcccgttcctggaggcccagatccgcgccggcgccgacatcaagtcgctgtccgacgggctggcccggttcacttccgaagtgcggcaagccgatccgcaactgcgcgacaccctggcgaccgcgcccggcgccaccgacgaggccagcaccgcgttctccggcatccgtccctccttcccggcgctggccgccagcctggccaacctgggccgggtgggcgtcatctaccacaagtcgatcgagcagctgctggtcgtgctgccggcgctgttcgccgcgatcaccaccgcggccggcggcgggccgcaggacgagggcgccaagctggacttcaagctcgacctcaacgacccgccgccgtgcgccgtcgggttcctgccgccgccgttgatgcgcacccccgccgacgagacggtgcgcgagctgcccaaggacatgtactgcaagaccgcgcagaacgatccgagcaccgtgcgcggcgcgcgcaactacccctgccaggaattccccggcaaacgcgcccccacggtgcaactgtgccgcgacccgaaggggtatgtgccgatcgggcgcaacccgtggcgcggcccgccggtgccctatgacaccccggtcaccaacgggctgaacgtgttgccgcccaataagttcccgtacatcccgccggacgcggagcccgaccccggcacgccgatcgtcgggccgccgccgccgggggtggtgcccgggccggggccgctgcccaacaagcagccggcctacgccccgccgccccccaacgacaacgggccggcggcgccgttcacctcgtggcagccgccgggggtgccgccggtgccgccacagctgccgtatcccaagtggctgccgccgccggcgccgccggagggcatcaatcgcgccgccggcgtccggggccgggataagccgtgggggccgccgcccggcgggcagccgcaggccagcggccccgcgtacgccacctatgacgagaagaccggcgcgtttgtcgatccgggccggggcactggtatcttcgcggccggcgcgaccgggacctccggcgccgagaactgggtggacctgatgcgtgatccaaggcctatgtgatggagccggtaatggaccctgccggggcggacgccgccgcggccgaccaaccgacgagcaggccgcgtgcccgtcggcgcgcctcccgcgcggcgggcccggccaagagcgagtcgacccagcccgtgaccgtcgcgaccgaggtggccgcaccgacgcccgccccgaaccgtcggccaaatccggcaagacgctcaagtcgctcaagccgccgccgcggcgccagccgcaccggacgctggtggcgtggatctcgttcgcggcggccgtgttggcggtgggggcgctggctggtggggtggcggtgctgttcgtccagcagcgcgacgcccaggccaaacagtcccgcgaccagcgtttcgtcgacaccgccacgcagacggtggtcaacatgttcagctacaagcaggacaacatcgacgagagcgtgaaccggttcgttaacggcaccagcgggccgctgcgcggcatgctcagcgccaacaacaacgtcgagaacctcaaggggctgttccgctccaccaacgccacgtcggaggccgtcgtcaacggcgccgccctggaaggcgttgacgccgttaccgataacgcgtcggtgctggtatcggtgcgggtcaccgtcgccgacatcgacggggtcaacaagccgtccatgccgtaccggttgcgggtgatcgtgcacgaggacgacgccgggcggatgaccggctacgacctgaagtatccagacgggggcaattgatgcgatggcggcgccggctgctcgtcgtcgcgggttacctgctggccgtggcgttcgtcgggctgtccgcggtggccggcgcgatgtattgggaccgggtccagacccgcggtgagcaggcggcgcgcgcggtgctgcccggcctggccgccaaggagatccccgaggtcttcgcctacgactaccagaccgtcgagcgcagcctgtcggccgcgtacccgttgttgacgccggactatcgcgccgagttccagaagagcgtcaacaaccagatcatccccgaggccaagaagcgcgaagtggtggtgcaggccaacgtcgtcggcgtgggagtcatgtctgcccaacgggattcggcgtcggtgatggtgtacatgaaccggacggtgaccgacaagtcccgccagccgctctacgacggcagccggctgcgggtggacttcaaaaagatcggcaagcagtggctgatcgcctacatcacgccgatctgaccccggttcagtagcacatcgcaataccgttgcagtacaacgggtatcgctcgatcgggctgggcggcggaccggtcatctgcagcgagaacggctgcttcttcatctccggctgcagtccgcacaccgcgccgtgcagcgtggtgtgggtgccgctcatggtctcgtcgctgaacgcgtaggtctcggtggtgggcgcggtgcccccgcccgggcaggacaccccgttgtccttttgcaccttgaacgtccacagcatgctcgacatccgggcgcggccactgaagttctgcagcttgtcggcggcgctgatctgctcgggcgtcgaactgacgatgttcagcgcgcagttgaacgcgaagacgatcgggtcggagtagtcgttcatgttgcgggttccggacggctgatcgcacagcgccgagatggtccaggtgaccccggaaacgccggcctcgttgtagttgtaggtgccgtccgccggcgggccgacggctttggccggctgcccggattgcaccgcgattccggtgcccaccgccatgacgacggcggcgcctgcggccaggccgtgacggagcttcatcgcaaccgcctctccttcacgttcgacgctgcctctgagtatcacagcgttgccgcgccggcaccatgggtccccgcggcgagagcgcccgatcagccgtcacgcggccccgactcggcgagcgcgtcgaggaacgaacgcgcccagcggtcgacgtcgtgcgcgagcacctgccggcgcaacgaccgcatccggcgccggccctcctcgacggattggttgagcgcggcctcgacggtgtccttgacgccctccaggtcgtgcgggttgaccagatacgcctgccggagttcggctgcggcgccggtgaattcggacagcaccagcgccccgccgaggtcgctgcgacaggccacgtactccttggcgaccaggttcatcccgtcgcgcagcggcgtgaccagcatgacgtcggccgccacgaagaacgcgatgagttcgttgcgggggaccggccggtgcaggtagtgcaccaccggatgcccgacctcgccgtactcgccgttgatgtggccgacctggcgttcgatgtcgttgcgcagctgctgataactgtccacccgctcccggctcggggtggccagctgcaccagcacggtgtcgtcgcgcttggcgcggccctcggccagcagctccgaaaaggctttcagccgaacgtcgatgcccttggtgtagtccagccggtcgacgccgagcagcaccttgcgcgggttgcccagctcggcccggatctcgcgggcgcggcgccggatatcgcggtgccgggccgtctggtcgagcgccgtggagtcgatggagatggggaaggcgcccacccggaccacgcgggactccagctccacctcgccgtagcgtgaccgcatccccaccgcgccgcgggaggtgttggcgccgatcaaccgccgggacaggaacaggaaattctgggcgccgccggtcagatggaacccgaccaaatcggcgccgagcaggcccttgacgatctccgtccgccacggcagctgcatgaacagctccaccggcgggaacgggatgtgcaggaagaagccgatggtcaggtcgggccgcagttcgcgcagcatcgccggcaccagctgcagctggtagtcctgcacccacacggtcgcgccgcgcgcggcggcgcgcgaggtggcctcggcgaagcggcggttcacggcgacgtagcggtcccaccattcgcggtggtagatcggtttgacgatgacgtcgtgatacagcggccacagcgtggcgttggagaagccctcgtagtattcggcgacgtcgtcggcgctcagcttgaccggccgaagctccaggtcgtcctggacgatcgggtcgtcctcgtggtcgacgtcctcgtcgacgatcccgggccagcccacccacgccccgcgctggcggcgcagcagcggttcgagggcggtgaccaagccgccggggctgcgcttccaggccgtgctgccgtcgggaagccgctcctgatccaccggcagccggttggcgaccacgacgaagtcggagttgccgtagccggccgtcttcgagcctcgccctcccccgggagccatctacgtgtcgagcttcgccggcccaataccgagcatggacaggaagacccggcactcgtcggcgtcgttggcgtacgccgccacgacccgcctggcctggctcgcagtgctgtcggcgaccggctcgacgtcgccgatttcgcccggatcagatttcgtaggcatgacttaactgtaagcgacgcgcgcgagcggccgcagctgtgtctcaccagctaacgggcgtcgagcgtatttatcgccggtttgcagggattcgccgcgccgcgcgcgaagacacggtcggccggcgccgcggtgttgcaggatgagcgggtgaccgctgaggagccggtgttcgagttcgtcgacgtcgtcgtcgaacggcgcgggctgcgggcgctggacgggctgaccgccgcgattcccgggcgcggggtgacggcggtgttcgggccgtcgggatcgggcaaatcgaccctgctgcggttgtgcaaccggctggagctgccgacgagcgggcgggtgtccttctacggctccgacatcgccgggctggacccgctgtggctgcggcgccgggtcggcatgtgtttccagcgcccgaccccgttcccgggcaccgtcgcggacaacctgcgggtggccgacccggacgccgacgaggcgcgcatgcgcgagacgctggaccgggtggcgctgaccggtgcgtggttggaccgcgacgtgctcgccctgtccggcggcgaggcgcagcgggtgtgcctggcccgcacgctgatggcccgcccacgggtgttgctgctggacgaacccacctccgccgtcgacgccgaagcggccgaagtcatcgagcgggcggtgcgggagctggccgccgacggcacgccggcgctgtgggtgacccatgacgcggcgcaggtgacgcgggcggccgaccgggtgctgcggctggagcgcggccgcagcctggggctcagccaagtcggcggcgggcccgacgacggcgcggtgccgcgatgaacggccaggtcggctggctgggcctggcgacgtcgctgatcctggtggcgttcgcgggcgcgatctcgctgtggcggcggttgggcctggagcgccagctgctgtgggcggcctcccgcgcgttggtgcagctgctgctggtgggcggcgcgctgacgctgctgttcgagccgggccggtcgctgtggtggtcgtgggcctgggtcgcggggatggtcggctacgccggggacgtggcccggcggcgggcgcccgaggtgccgcggttcgccccgctggcggtggcggcgttcgccgccgccgcggtggtgacgctcggggtgctcttcgggctgcgggtgttcccgctgcaggggcgcaccctggtgccggtggccgggatgatgatcggcaattcgatgaccgccatggttctggtggcccggcggttggtcgacgagctgcgcgacaagcgcgacgaggtcgaggccaggctggccctggggcagccgtcgggccaggccgcctccccctacctgcggatcgcgttacggtcggcgatatccccgcagatcgagacgaccaaggccaccggcctggtgttcctgccgggcgcgatgaccgggctcatcctggccggcgtgccgccgctgcaggcggtgctggtgcaggccgtggtgatgttcttgatcctgggttcggtcgcggccaccacggtggtcgtcgcgctcggcatcgtccggctggtgttcacccgcgaccatcggctgcggccgctggatcagcggccgccggattgaccgtcaaccccggggcgttccggttacacactggccgtaatgtgtaaacaatcctgagccgacgacaagcgaggtgggcgcaatgactctctccgagcaagcgggggcgcagcccggcgcccggccggccgaggagctggtgacctacgaaaccctcgacgagggccgcatcgcgcgcatctggctcaaccggcccgacgcccacaacgcgcagagccgcgggttgctcgttcagctcgacgaggcgttcgtgcgggccgaggccgatgacgccgttcgggtggtcatcctggctgcgcgcggcaagaacttctccgccggtcacgacctgggctcggagctggcgctcgccgaacgccagcccgggccgggccagcatccgaccttccggttcaacggcgccacccgcgatcccatcgcggagaagacctacctgcaggagtggcactacttcttccaaaacacttgccgctggcgggatctgcgcaagatcaccatcgcccaggtgcagggcaacgcgatctcggccggcctgatgctgatctgggcgtgcgatctgatcgtggccgccgacaacgccaagttcagcgatgtggtcggcgtccggatgggcatgccgggcgtcgaatactacgcgcacccttgggaattcggcccccgcaaggccaaagagctgctgctgaccggtgatgcgctggacgccgacgaggcctaccggctgggcatggtgtccaaggtgttcccggccgacgaattggccgacaagacactggaattcgcgcgccgcatcgccgagcggccgaccatggccgccctgctgatcaaggactcggtcaacgccgcctcggacgcgatgggcttcacggaggcgctgcggcacgcgttccacatccacgagctgggtcacgcgcactgggcggcgcacaacgagaacaggtatccggtcggcctgccgcccgacgtcgaggactggcgcaacgccaagccgaccaggctggcccgccgcgacaccccgtagcgagccctaacgagaccgggggtagcgatattcaccccgaggggacatgcttctatagctagaacctgttccagttcgaaagggcctcgcgtgcagctttccttccaagaccggacctatctcatcaccggcggcggcagcgggatcggcaagggcgtggccgcgggcctggtctcggccggggcgtcggtgatgatcgtcggccgcaacccggaccgcctggccggcgccgtcgaggagatcgcgccgctggccgaccgcgccgggaacggcggggcgatccgctacgagcccacggacgtcaccaacgaggacgaggtggcccgcgcggtcgacgccgcgacggcatggcacggccggctgcacggggccgtgcactgcgccggaggctcgttgacggtcgggccgatcacccacaccgactcggaggcatggcgaaacaccgtcgacctcaacgtcaacggcaccatgtatgtgctcaagcacgtcgggcgcgaactggtgcgcgggggcggcggctcgttcatcgggatctcctcgatcgccgccagcaacacccaccgctggttcgggccctacggcgtcaccaagtcggccatcgaccacatgatgatgctggccgccgacgaactcggggagtcgtgggtgcgggtcaacagcatccgcccgggcctgatccgcacggatctcgttgacgccagcgtgattcagtcgccggagatcagcgcggactacgcccagtgcacgccgctgccccgcgtgggcgaggtcgaggacgtcgccaacctggcgatgtttctgctcagcgacgccgccggctggatcaccggccagtgcatcaacgtcgacggcggccacatgttgcgtcgcggccccgactactcgtcgatgatggtgcagatgttcggccaggacgcgctgcgcggcgtggtctgagccgggagaatcgcatgaaaaggcttgagggcaaacggattttggtgaccggcgccgcgtcgggcatcggccaggcgaccgcgctgcggttgctggacgagggcgccgcggtggccgcctccgacgtcgccgtcgacgggctggagcggacccgcgaccgggcggcgcaggcaggcaccgccgagcggctggtcaccgtgaccatggacgtgggccgcgaggacgcggtggtcgatggcgtgcgcgtcgccgtcgcgcagctgggcggcctggattcgctggtcaacgccgccggcatgctgcgcgccgcgcacacccaccagaccagcctgcagctgtggaaccagatcatcggcgtcaacctgaccgggaccttcctggtggtccgggaggcgctgccggcgctgctggacaacgcgcgcagcgcggtggtgaacttcagctccacgtcggcctcgttcgcccacccctatatggccgcctacgccgcgagcaagggcggcatccaggccttcacccactcgctggcgctggaatacgcgcgccggggcctgcgcgcggtgtgcgtggcgccgggcagcatcaagtccggcatcaccgacgccaccggcggctacatccccgaagacgccgactggtcgctgttttcgcggttgctgccggtgctgccgaccacggtggaatccagcggcaccgggatggccgagcccaccgccgtcgccggggtgatcgccatgctggtgtccgacgacggcgcgttcatcaccggcaccgagatccgcatcgacggcggaacccacgcctgagagttcagttcacgcacggcacgccgccgccgtcgatcggtttcccctgatccggcgtcggatacgtggtggtggtgccgttgtagtagtaggtcttggccttgctcgacgtggtggtgctgctggtgctcgtcgtgtcgtccagctgggtgtcgtcggtggtgggcatcgtgaagttggtgtccaccgtcagccggatgtggccgggcgcgatgctggggctgggctggttgggcgcgtccaggctgagcaggttggccaggttgcgcgcgtcgttttgggcgccggcgccgtactcgatggtggtggcggccgggtcgccggactcgcggtcgcggacctggcccgtggtgtagccccgcttcttcagcgcgtgcgacacctcgctggccagcccgctcatgctgccggagttgaccacgtcgaccaccgtggacggatcgggtgcgacggacgtgctggtgggcgcggacgtcggcgcgttggcgccgatcgcggccgccacctccgccttgatcgccgcggggtcgacgatgttgacgtcctgaccgtcgatgttgtcgtagcgcaccaccggcagcgtgcggaattcgatgttgccgccggccagcccgcccagccgctggatcatgtcgtcggtccagcccgccgacagcaccacgtccttgcgcgccaccgccatcagattcttgagcttgtcgatgttggtgaaggtgcccgccgcctgcagctcctgcatgaccgaggagatgaacgcctgctggcggtgggtgcggtccagatcgccgttgtccaggccgtgccgctgccggacgaacgagagcgcctcggacgcatccagccgctggcgcccggccgggaagtcggcgccggaatacgagtcgtagacgggatggttcaggcacacctcgacgccgcccagggtctgcgccaggtcgtagaagccggccaggttgacctcggcgaagtagtcgatgggcaccccggtcaggttgcgcaccgcgcgcagggtcgccgcccggccggcttcgcggcctttggtctcgagttccttctggctgctggtgccctggttggccagcttctgggcgacgtactgcttggtcagcccgtacgcctccttgatcttgatgtggttgtatccgggcaccccgctgaacggcacccagtcgtcgcgggggatggagaacgcgacgaccttgttgtcggcgctgacgtgcaccaggatcagcgtgttggtgttgtagccgccgtcgtcggaatcgcccgcgtgcaggtgcttcaggatcgaatacggtaggtcgttgccgtcctggtccttccgcgagtccagcccgatcagcaggatgttcatgttgtcgccgctggagcggggatcgtcgggttgcagcgcgttggacaccgtgatgccgcccagcgcgccgtgcgcgacgtagtatccggcgccggtcagcccgatcgccgccacggagaccagcgcacccagggtgcgcgtcagccccttacggaaacgggagggctgacggacggctcgatgacggcgatgggcaccgcccgagcgggccatcacaaacctctgcccacacccagcacatcgccgggcgccgtgacggcggtttgcggcgatgttgctccaagcatggtgacaagtatgcgttagctcgctgtgaagcccccaatcgagagcacccgtcaccaggggcaaccgggcgcgtgggtggcgccggtttgcgccggcgatcgccgccccacctgcgtgtttacccccgactggggccgggtggggccgcgccgatctccgggaggtctcgggccgaacacggcgctgtccggatcgactcgcattcgttaccgcgccgacaccgcacctggccgcgctagcgggccttgaccaggtcttcgcccgattggtagaagagcgcgatgttgctgccggtgacgatctcggcgaggtagacgccgacgggttcgacctcgtagtagtagtgggcgttgccctcggtgtccagcgtcgaggcgcaggacagccccggcgcgccgcagcgctgcttgatgggcgccgcgagggcggcgagcagcacgaccacggcgatgccgatggtcagcgggattcggtgcaccggtgaccccgttcgcgccagattcacggctggagtgtaagcggccgaccccgcgggtacgcggccctgagccgagcgaagggccgagcatgaccgagaccgcttgcggccgctcccggcggcgcggcggcgaaattccgagccgcccgagcgcgaggcggacgcgaacaggattggagggcaggcatgcgcgccgaggaaggcgacgaatccgtcaaggactatgcaaaggaaagccgggaaaccctgggtcgcatcaaggcttcccaacatggcggcggtcggctcggcgccatcgcccgccgcttcgcgcggctgtggcgcggaccccgcggaccggaggacgccggtcccgcccgctgagcgcgtaagcgcttgggccgcaggctaattcggtggggtgaccggcgccgggtggcgctgcgcccacggccgggcctgctcgagttgcgcggccagttgcagcagatccccgtcggcgccgagcttcccgacgaactgcacaccgagcggaaggccgtcgtcggtccagtgcagcggcacgctgatcgcgggccgcccggtcaggttggccagctgcgtgtagggcacccagcccaggctctcccggatgaggtcatcgagaatcccgctgagccgcatcagtttaccgccgcgcaccctgctgaccaggcgggccgcgcgctgcagcgccgccgacgtcgaggtggcaccgaccaccaggggaggggtggccagggtgggcgtgaggaagaagtcgtagccctcgtggaacgccgccagcgactggatgtaggtgttcctgttctccagggcggacatcaccggcagcaccccgccggaccggccgagctcactgattgccaaggtgtcggcctcgaagtcgttgtcgcgggccccggttcgcctcctgatgtcggcgacctgctggtgcagctgggcgaaccagatggtcaggaagtcacgccccagcgcggcgtcgtcgtaaggcggggcaacctcgcgcacccggtggcctaactcgctcagcagggccgcactgttctcgacggcgacgacggcctcgcggtccgggcgcgggttgagcgccgaacgggccgagtacccgattgtcagaggtcccggagggcgcgtgatctgttcggcaaagggcttgtccggcagcgcaactcggtaggacgcgtcggggtggtgcccgatgatcgcgtccagcagcgcggcgctgtcgcgcaccgtgcgggtgaccacaccctgggtggccatgcccagcatcagctcgccggtctgcgggccgtagggcgccaacccccggctgggcttgaggccgacgaggccgttgcaggcggccgggatgcggatcgacccgccaccgtcgttggcgcccgcggccgggacaatgccggccgccaccgccgcgccggatccgcccgacgagccgccgggggtgcgttcggtgtcccacggattgcgggcgggtccccagtaatcgggctcggtcgcccccttggccccgaactcgggcgtattggtcttgccgaagatcaccagccccgcgtccaggaaccgctgggtgaccagcgcgtgccggtcggcgacgtcgttggccagcgaccgtgatccgcacgaggtgggaaagccgcgatactcctggccgaggtccttgagcaggaacggcaccccggcgaacggcccgctcaggttcgggtcggcggcttgccggtcggcgacgtcgtcgagtcggcacacgatggcgttcaggcgcggattcaccgcgtccgcgcgctgccgtgccagcgcgagcagttcggccggcgtgacctgcttgtccgccaccagcccggccagggcggtcgcatccaacgccatgtactcgtccagacgcatgccgttgacgttaagccaccgcgggcccggccgggggccgccttagtatcacctggtgcccatggcagccgaacccttcacgatccgcggccccggcggcgttcagatcgtcgccgaccgtctcggggatcctcgcgcgcgcgccgtggtgttcctgcacggcggcgggcagacgcggcggtcgtggggcaaggcggccgccgccgtcgccgcccgcgggtggcaggcggtcaccgtcgacctgcgcgggcacggcgaatcggactggtccggcgacggcgactaccgggtcgtcagcttcgccgccgacgtgcaggcggtgctgggcacgttgcccccgaagccggtgctggtcggcgcctctctcggcggtttcacctcgatgctgctcgccggcgaactgtccccgggcatcgcgagcgcggtcgtgctggtggacatcgtgccgaacatggatcagtccggggccaaccggattcacgccttcatggccgaccgggtggattccggattcgcctcgctcgacgaggtcgccgacgcgatcgccgaatacaacccgcaccggccgcggccaaccgatctggagggcctgaccaccaacctgcgtcgccgcggcgatcgctggtattggcactgggatccgcaattcaccagcggcacggcggctttcccgccgttcgaggtcaccgacccggatcggatgcacgcggccgtcgaggcgatcctgcgcgacggcgtgcccatcctgctgatccgcggccagatgagcgacctggtcagccaggagcgcgccgacgagttcctggcgcgcttcccccaagtcgaattcaccgacgtgcgcggggcggggcacatggtcgccggcgaccgcaacgacgttttcgccgacgccgtgctggatttcctggcccgccgcctcgacgtcgaatgaaccacgggaagggctgggcgccggcctctttcggcccggcggcgctgctactatctgccgggcgcaagcggagaagggcggcgtgaccgtgtcgtggctgcgggggtcggggctcgtcggggcggtgttggtggccgccacggcggtggcgaaaaccgcgggcgcggcaccccctccggccctgccggccccgccgccgtcgccgggcatcggcgtcgatcacgaaaacggcaggtgcacagccggattcgccgcccagggttccgacggcagctactacctgatgaccagtgggcactgcgacgcgcacgacggcgcggagtggacgtacgggaacgacgctccgctgggcaggatctcggccagtgaacacgagggcgacaagcgggacgccgcgatcatccggctcgagccgagcgtcggcatgcccgtcggtgacgtcggtggcaggtatcaggtgcgggatgtgttgagccgcccgcagattcaggtcggcatgccgttctgcaagatcggggcggtcaccggggagacgtgcggtgccatcaagggggtcgacggcgacgtcgtcgaggccagcgtgttcagcctggacggcgacagcggcagcccggggttcgtgatgaatcccgacggcagcgtgagcgcggtgggcctgttgatgtcctcgcccgacggggacgactacaccacctacttcatgctggtcaatccgctgctggaccggtggggcctgcggattctgccgtgacgtttgcgcatctggggcatggggtatccgccggaccggcctcgaacgcgtcggccccgggaccgttgacgggctgtcggcgcggccaacggcaagaggcgggcggaaccagcgacacgaagggaacagtagtgaagcgtgggatcgtagtggggttggccggagtggccctggtgatcggggcgagcgccggttgttcgagcaacaagtcgaacaccggggcgtccggttcgtcgggcgcgccggcagcggcggccccgcagctcatcgtcgacggtcaaacccagaacgtcagcgggcaggtcacctgcaccaccaacggtgacaagaccaccatcggcatcggcgacccgaccgccggcctgggcgccgtggtcagcaacggcaatccgcccctggtgcattcggtcggcttgggcaccgtcaacggcgtcgcgctcggcttctccgacgccgccccgaatcagggcggcaacgccggggccgcggtgaacggaaaaacgtgggcgatcaagggcaccgcgaccggcgtcgacatgagcaacccgcagcaaccacagcaggtaaccaagtcattcgagttggacgccacctgcccgtagtgcaggccgtcggacacccaagggggacgcagctatgtcaatgaaacgtgtggtcggcgccgccgcggtggcggccggcctaggcatctccgcggcgtcgctgaacgccggatcggcctactcggctccgcttgaccccccgccgccgtgcccgaactgccacggtggtggtggcaaccccggcgggccgggcggtgggcccggcggccagccggccggtcccgggggcggcgccggcggccagcatggcggcggcaacaccccgccgcagggcgggcagaacaacccgccgccgaacggcccgaacaacccgccgcagaacggcccgaacaacgcgccgcagggcgggcagaacaacccgccgcagggcggcccgaacaacgcgccgcagggcgggcaaaacaacccgccgcagggcggccccaacaacgcgccgcagaacggcccgaacaacccgccacagggcgggcagaacgagcccggcggccagtacccgccgaaccagcacggccagaacccgccgcagaacgggcagaaccagccgccctacgaccacgaccagaacccgccgacgccgggcggaccgaccaatgcgccggcgaacacccagaacccgccgccaccaccggagcggcagcgctacgcggcgctgaacccgcccaacacccagccgccgcacccgccgtacgtgccgcgtcacgacgtcgtcaccgccagcgcccagatcggcggcccggccggtgccgacgtccaattcagcatcgtgggtcgcggcgcgcccccgccgccgcgcgagcacggctacggctggaacgacggcccgccgccgcaccacccgccgccgaactggtacgggccgccgcctcccggcggctgggacggtccgccgcctcccggtggctggaaccggccgtgggacggaccgccgcgtgacgtggcggtggcgcgggccgacttcgggcccttcagctacaacaccttcaccgtgatcccggtcttcaactggcagtacggcggttggggctactggttcttcggtgtgtgggtgccgctgtactgatccgcgtcactgcgggtgcgccgccacgtagtcggcggccgggatcggtgacgacgcgtcgtaaccgatgggcagcaacacgtcgcccgccgtcgtgaagcagtagacgtcccaccggtagtaggcggcgaaggttgcggggtcggcggccatcagcgccgcatactggtcgaccgcgcgcacgtattcgctcgcgtggttgtaggcgtagatggcgtggtcccgatcggcggcgaaaccgttggccgccaggtagcggcccgcggccaggatgctgtcgcgcggcgagtggatgtcgccgccctgcccgtagccggcgaaggtcgacggcaggaactgcatcggcccctgcgcgcccgcggtgctcgcgccgacgatgctgccgaaccgcgtctcgatgaagttgatcgccgccaggtagttccagccgacaccggactccgcctcggcctggtggtagtagccgagcagctcgtcggcgggggccggcggctcgattcgccacgccggcaaggtgtttcgcaccggagtcaacgcggtgagctgccggcgggcgtcgacgttgcggtcgtagacgtcaatgagctcgggcgggatccgcccccgcgcggccgcctcccactccggatggcgggcgatggcgcggtaggccgcctgttcgcggtgcgcggccgccgtcagggccggctcggacgtacccgggtcgcgcagggcgcgctcgtcggcgacgaggtcgtcgccgagctgggccgggtcggaggccagccgcggctgcgcgccaccgggcgtatccgcgtcggcgggcagcattcgcgacgccggcgccgagggcgcggcggtccgcgtcgcggttgggcgcggcgcggccgacgggtgcgacggcgaacagccggcgagcgcgaccaggaccgcggcggcgacgagcggtgcggtgcgccgattgctcacggtgaatccttagggccgacgggttcacagcgagtctttcgcatccgggcgcgacacatcaatgccgcggcggcgatcgatcgggattggtcggcgcccggggcttgtgacaatgccgccacactctcaaactggttgatatgcgcgaccgcgagaccatcgacgcggaattgcggcgcatcgccctcgcgcgccgatcgattcaccggcaaggcggccaaccgtcatcgcgcgaggtcgacgaactgctcgacgagctgctggcccacagcgccggccaggccgtccgcgaccaggcgacatcgccggaaaccgcggcggccgccacgtcccgccggcacggcggagcgctgcgccgcgccggcctactcgcggcgttgccgctgtcgctgatcgccgtcgcagccgctgcggtgatgattttctttgtccaccaacgcgattcgacggcaccggcgaccgaacccgcgccgtcggccgcgccgcccaaagcggcggcgcccaaaccgcccgcgccgcggatcgagatggccgacatggcgttcatcgccgcgctgaagcacgagggcgtgccggtgcccagccaggactacgtgatgaagcaggggcacgcggtgtgcgactttctggcccagcaacacaatttcgccgacgccatcgggttcgtgcagcgctcgtcgatctggaacgccgagcaaagcgccgaggtcaccgctggcgccatcgtcgcctactgcccgcagtcgcaagccaccgcggccgacctgaccggcccggcctatcagaacaccctctcggatctgcaggccatcgagggaaagctgcagggcatcgagggcgatctgcagggaattcagcgggacctggacaacatcccgggccaccggtaaccgtagccggcgcgcagcggttcggccatatcgccgcagcgccaccggtttgcggcataaagtccccttcgtcccgatgattctgccggcgcgcgacgggggaaatcatgttcgatgcagtccgctggcgtttgtcggcgggcgcgatggccgtcgctgtcaccgtcgccgcatgctgtgcgccgtccgaaccggcggatccctgcatggtcgcctccggcgcggcagacgagtcgcagggcatggatgccatggcgatggcgaccgaggcctgtccgctggtgcggctgaccgagaacgatcccgacccgccgttgtatccctacctgggaagcgcgcattggcacgtgccctgggcgcaggagtatttcgatcagggcttgcgcttctacttcgggttcaacaaccgcgaggcctatcgcgcattcaagaaagcggcgcgtgacgccgaggacaacgacatcgcctgctcggcgtgctattgggcgcaggccctcgtcctgggcgtcgacctgaacatgccgagggaattggagcccgaccgcgacgccgcgaacaacgcgctgcgccgcgccgcccagcaaaagccgaaccgggaagacgacaaaatcatcgccgccctaaccggacgctatcgggactgcccgaaaaccgtcgaccccaggaaatgccaggcgggccgcaaccaggcctactacgacgggatgaaggcggtggtggacgagttcggccgcgacgaccccaacgtcatcaccctgttcgccgacgcggcgatgaacatgacgccgtgggcgtactggaaggacgggaaccccgtgtccccgcggaccacgcaggcgcgggagtatctcgaaaaggctttggaattaagccgatacccgccgaacgagggccccatccactggtacatccacctgatggagcagtcccgcacaccgggcgcggcgggcaagtatgcggaccggctggcggcgctggcgccgaactccggtcatctggtccatatgccgtcgcacatctactaccggatgggcgacatgccgaaggcgatcagggccaacaaagaggcgatcgacgccgacgaaaggtatttcgcgaccgaaccgcatctgtaccgcccggacggcgaccgctaccggtacggatattatttgcacaacatccatttcgtgatcgccgccgccgcgttgagcggagacgacgacgaacacgacgtcgaccgttacgcggataagttgctgcagtggctgcccgacaacgccagcggtttccgcgccgacgtctaccggtccgcctactatttggccaagatcaatttctccagcacggccgacatccgtggcttcgatccgccgagcccgttcaatcagcagccgctggccaccatcgcctacgacttcgcgcggctgatggccgatatttgggataaaaaccattccccgcactggctggacacgctggacggcgacgtcgccagataccgccaacacgcaaccgccagcggcaaaccgaacgcggactgcgatccgaagctggagctgccgaaacccgagctgtgcctggccgcgatcctgcgtgacctggggcatgcgcgggcgtcggcggccaaggccgattggggcgccgcggccgatgtcgccaacgaagccgtcgacatccaggacaagctgccctacgacgagccgcccctgtggccctaccccgtgcgccagacgctggcgtcgatcctgatccgccgggcgatcgccgccggcaacccgatggaccgggccctgcacctggcggcggccaaggagctgctgctgaagagcctcaacaagggcaagggcgacgaccccgagcagaccccgatcgggacgtaccccggcaacggctgggcgtactacgggctgctggagatcgcgacgcgggacggctccccaccggaggtcgtcaaggcggccgacgccgaactggtccggcactggttcggcggcaccggctaccggaacctcgatcgcctctaggccgcgcctgaagggtgtgcgaaaccgaagccgttgccgggcaaggccaatcgaaggccgcccgaaggcgaccgatgctgcgagcccctgttcagagtcggttgatgggtgacatttctatgtcggttgatccttgacactctgggttagtggttaggcctgttcgcgggtgcggaaggcccgtttgtttcttacctctgcatggttggtgcgcgcagcggtcttgactaactggtcgccgatccagaaccgcagcagctcaccgtcgacgtggacatcgcagcgggccccggcgtagtgggctcccacgcagacctgctgccaggccacactgaccaccccgttggtcgttacccggcggctgacccagtcctggccgtctcggtcgatgctggcgggtacgtcgtcgccagggctcaccggcgaggcggtggcggtgaaccgttcggctggggtggtcatgttcagcgattgatgcggacgggcggtgttgtagtagtgcacccattcgtcgagggcttgctgagccgtcttcagatttgagaaagcccttgtgttgctgaggaattcggcgcgcagactgcggtggaaccgctcaatcttgcctgtcgtcgtcgggctacgcggctgggtgagcaggtggtcgatgccgttttgccggcagatcgcgtcgaagagcacctccaccgggggatggttaaaccggccggtgaacaccttgccgttatcagtcaaaatctgctggggggccccgtaagccgccagcgccgcccgcaatccgtcgcaaaccgcgcgggtacgctcacgcgccatcaaccgcgcgcagacacacatccgggaatggtcgtcgatgccggtcaacgctttggcgctggtgccatcggccagcgggaaaccccccaccacatccatctgccacagctccatcggggcgccgcgttcccaacgtttccacttgcgcgaacgccgatcccgcaaagccggatcgatcatgcccgcccgcaccaaggcccgatacaccgccgactccgacggcaccggacccacccgacgcttagccagctcgaacaccagccgccgtggtccccagtacggccgcgaccggcgccgctccaacagggcggcctccaccacggccggcatctggtgcggacacgacaccggccgatgcgaccgatccaccagcccctcaaggcccgacgcctcatagcgggccaaccacgcgtgcagcgtctggcgcgacacgcctaccttctcggcaaccagcgaaatcgacaacccatcgctgatcaccgccaacacggcctgatacctctgctcggccacggttaactccttcatcgaaggagtgtcaaggatcagccgaagtaactgtcaagcatcagccgaaacactgtcaggcatcacccgaagccgaaacgtcacacatcaaccgacgtcatacagatgctgcgagccccctgtcaggattgaactgacgaccgctcgcttacaaggcgagtgctctaccactgagctaaggaggcggggtaaaaccggaccccagcctaatcgctcactcgtcggtgtcgatcacgcgtgccgatcgcaccgcgcgcgacgacgggcgccgccggcccggcaacgggatccggtcggcgatgttgctcagcgggttgaccaccatggtcagcgcgacgacggcgtcctgcaacgtggcgatcgcgggctcgagcgcctccatcccgggcgtcaaccgcgccagggtgtcggcgacgtcggcgagctggtccagcggcccgtgcttggcggtcagcttgtcgatcagcccgccctcggccagcagccggtcggccagcccgtcctcggccagcagccgctcgatcagcccgtcctcggcgaccagctggtcggccagcccgccgggctgcagggtgcgttgcagggcgccgccctcggcggtcaaccggtccagcaggccgccctcgctggtcagcatgtcgaccaccccgcctggacgcagcaaacggtcgagcggcccgtccggcgccaccgcccggcccagcggcgcgtcgtcgtcgagcagccgggccagccggttggcccgcacgatcgcgtcgtcgatgcccagcatcgacgtcatcgcgttggtgccggcggtgccgctgtcgcccagcgcccgcttcgccacgccgacggccgcgctggccacgctcagacccgcgtccgccgcggccagccccgcccgggccggagcggtcgcggccgacacgatgttcttggcgaggttcattccccgagtctatgcacgatgaggcccggaaaaccccgatccgtcccaaggcaatgcgatgattcctggcagactactatcagtctgttggcactgagctcgcaggaatcacacaatctttccatagcaaacgttcaagcaagggacaccagcacctcatgacatcggccacccccactgacgccaaaccggaggctcgcgttctcgtcgtcgacgacgaggccaacatcgtcgaactgctctcggtgagcctgaaattccaggggttcgaggtccacaccgccaccaacggcgcccaagccctggaccgggcgcgcgaggcccgtcccgacgcggtgatcctggacgtgatgatgcccggcatggacgggttcggggtgctgcgccggctgcgcgccgacggcatcgacgcgcccgcgttgttcctgacggcgcgagattccttgcaggacaagatcgccgggctgaccctgggcggcgacgactacgtgaccaaaccgttcagcttggaagaggtggtcgcccggctgcgggtcatcctgcggcgcgccggtaagggcggggccgaaccacgcagcgcccgactgactttcgccgacatcgaactcgacgaggaaacccacgaagtgtggaaggccggtcaaccggtctcgctgtcgccgaacgaattcacgctgctgcgctactttgtcatcaacgcgggcacggtgttgagcaagccgaagatcctcgaccacgtgtggcgctacgacttcggaggtgacgtcaatgtcgtcgagtcctacgtgtcgtacctgcgccgcaagatcgacaccggcgagaagcggctgctgcacacgctgcgcggcgtcggctatgtgctgcgggaaccgcgctgagcgcgcgctcggccaccggcggtagcgaggaatcggtcagatggtggtgacaaggcctcgacgcggactacccctgcgggtggggctggtcgccgccaccctggccctggtcgcctgcggtctggccgtctccggcatcgcggtcacgtcgatcctgcggcacagcctggtcagccgcatcgactccaccctgctcgacgcctcccgcggctgggcgcaggccccgcggcgccagtcgtcctcggcctacgagggcccggacccgggccgcccgccgtcgaagttctacgtgcgcggcgtcagcaccgacgggacgccgttcaccgccatcaacgaccgcaacgccgaaccggcgctgcccgccaacaacgacgtcggacccaacccgacgacgttgccctcggtgaacggttcggacatccagtggcgcgccgtgtcggtgcgcggcccgcacgggctgaccacggtggccatcgacctgtccgacgtccagcacaccgtcagctcgctggtctggctgcagatcggcatcggggtcgcggtgctggccgtggtgggcatcgccagcttcgcggtggtgcagcgcagcctgcggccgctggtcgaagtcgaacagaccgccgcggcgatcgccgctggccagctggatcgccgtgtgccggaacgtgatccgcgcaccgaggtgggccggctgtcgctcgcgctcaacggcatgctcgcgcagatccagcaggcactggcgtcctcggagtcctcggctgaaaaggcccgcggctccgaggaccggatgcggcgcttcatcaccgacgccagccacgagctgcgcaccccgctgaccaccatccggggattcgccgaactgtatcgccagggcgcggcccgcgacgtcgcgatgttgttgtcgcgcatcgaaagtgaggcctcgcggatgggcctgctggtcgacgacctgctgctgctggcccggctggacgtgcagcggccgctggaacaccaccgggtggacctgctggcgctggccagcgacgccgtgcacgacgcgcaggcgatggaccccaagcgcaccatcaccctggaggtcctcgacggccccggcaccccggaggtgttcggcgacgagccccgcatccggcaggtgctgggcaacctgatcgccaacgccctgcagcacaccccggaaagcgccgacgtcacggtgcgggtgggcaccgacggcgacgacgcggtcctcgaggtggccgaccggggtcccggaatgaacgagcaggacgcgtcgcgggtgttcgagcggttctaccgcaccgactcgtcaagggcgcgggccagcggcggtaccgggctggggctgtccatcgtcgagtcgctggtgcgcgcgcacggcggcaccgtcggcgtgacgaccgcgcccggccagggttgctgcttccgggtgacgttgccgcggatcagcgacgtgcccgcggttcaggccagctgagccagggccgccttgatcttggcctgggcctcgtccagggactccggggacgggttgcggtccacgttggcgaagccgaagtcgctgaggctgcgggtggggaagacgtgcacgtgcaggtgcggcacctccagcccggcgatgatcaggccggaccgttcggtccggaacgccttgcacacggccttgccgatcagctggctgacacccatgacccggttgaaggccgcgctgtccacgtcctgccagttgtcgatctcctcgcgcggcaccaccagcgtgtggccctgcgtcatcggctcgatcgtcaggaatgcgacgacgtcgtcgtcctcgtagacgaagcggccggggagttcgcggttgatgatcttggtgaagatcgacgccatgggcccagcataggtgcgccggattcggcgcggctcacgactcctggccgaactgcatcatgtccaggttccagtacccgcgcatgttggtgatcagccccgcctcgtcgaccttgtaggtgaacaccccgcgtaccgagctggtgacgccgccgtcgaacctgctgttgagcaccaggatgtgggcgatctcgtcgggcgacgacgacgggaaggtctcctcgcaggtgatggagagctggttggccgcgatgttggcgtcgacggcctccttgccgcggaccccggtgccgtccgggttggtgacggacttgccgatcgggtcctcgatgacgacgtcgtcggacatcaacgccaaccagcccgctcggtcgtgcgcctgcacgcaccgccacgaggcctgcgacgcggcgagcgccggggatgccgctgcggtttcggtcatctgtactcctgatgttgcgcaccccttggcgccgattcgtcccggcgccaaggggtggccgaaaacgggttaccggtcggcgtcggtgtagcggatgacgccgcgaatgttcttgccgtccaacatgtcctggtagccgtcgttgatctgctcgagccggtactggcgggtgatcatgtcgtccaggttgagcttgccggccttgtacatcgacagcagctgcgggatgtcgtactgcgggttgccaccaccaaagatggtgccctgcaagttcttctgcatcagggtcagcatcgccaggttcagcgtcacgttggtgtccagcaggctgccgatggcggtcagcacgcaggtgccgcccttctgggtgatgttcaggtagttgtcgacgtcggcgccctgcagctcgcccacggtgaccacgaccttgtgggccatcaggccgtaggtcacctcggccatgccggccatggcggccatgatgtcggggtagacgtgggtggcgccgaacttcagtgcctggtcgcgcttccactccaccgggtcgatcgcgaagatgtagcgggcgccggcgttgaccgcgccctgcagcgccgccatgcccacgccgccgacgccgacgatggcgacgtcctggcccggccggatgtcggcggtgcggaccgccgacccgtaaccggtggtgacgccgcagccgaccagcgcggccacctcgaacgggatcgacgggtcgatcttcaccaccgagctgcggtgcaccaccatgtacggagaaaacgtgcccagcagcgtcatggggtagacgttctggccgcgggcctggatgcggaaggtcccgtcggacaccgcttcgccgcccagcagacccgcacccaggtcacacaggttgcgcatgcccgcctggcaggtcggacacgagccgcaggacgggatgaacgacagcaccacgtggtcgcccggggcgatgtcctcgacgccggggccgacctcggtgacgatgcccgcgccctcgtgcccgccgagcaccgggaagccggccatcgggatgccgccggtgacgaggtgatggtcggagtggcacatgcccgccgcttccatctggatcttgacctcatgcgcttgcgggtcgccgatctcgatttcctcgatggaccagggctggttgaactcccagatcagtgcgccttttgtcttcacgatggtcctgaccccatttcgcctttgaattgagaccgaccggccccttcatgccggccagctaggtgacgggtgccacaggcacccttgtcgcgtcagcatagcgcgtgcaacgaatcaaatgcttggttggtacccgcggcgatcgcaagcgcggcggagccgggcgccgcgggtcgccgccatcgacaccgcggcgatcgcaagcgcggcggagccgggcgccgcgggtcgccgccatcgacaccgcggcgatcgcgatccgcttcaccagatcgggacgggcgcctggccgagcgggtagtagcccggcggcttctcgccggcgacgctgcgctcgatccgcttctgcatgcccgcggacagatcgccggattcgatgagcttgccgaacatcttcgcgacgtgaccgaagtcgaagaagtcgcgctgccattcgatgaggttgtcgctgttgagccgaaaccagctgccgccgatgccgtagatctcgtcctgggtgccgtcggccttgttgacgatctgcttccagaagccgacgatctcgccctgcttctcgtcgatgagcaccttctggtattcgtagacccagttctccaggccttccatctccaaacccagtgcgatatcccggatttcgtcgaccccgacgcacatcacgtcttccttggggccgatgttccagccgtaggtggcgtccttggcgtagaagtccgccagcggccgccagtcgccggccttctcacagtccttgttggcctgcaaccagcggtcgacccaggcctcgagttcttcgcgtgacgccgttgctgtcatgggtcagtcttctttctctttgatgaacagtgcttgggttgggcacatttcgaccgcgcgctcgacctcatcgcgggcgtcttcgggcggctcggggtcgacgatctcgaccttgccccgcttgggaacccggaagtagtccggggcctcgagttcgcacatggcgtggccctgacacaaatccagatccgcttcgattctgaatccgctcatcggacgtactccttacgcattgcgcttgcggtagcggaccttcgccggccgggcgagctgcaccaccatcttggagtggtcgttgcggtagctgtccgcgggttgcgccatctcgaagtcgtactcgcgcaacaggaccgagaagatcgccttgatctgcatctgcgcgaacgccgcacccacacaacggtgccggcccgcgccgaacggaatccaggtccaccggttgacgatgtcggcctgctcgggcttgttgtagcggtcgggcttgaacgcgtccgggtcgggaaagtcctccgggatgcggttgctgatcgccggggaggccgcgacgtagtcgccctcgtggatggggaagccctcgacctcgaactcgcccttggccacccgcatcaggatgatcagcggcgggtgcagccgcagcgtctccttgaccacgttgtcgagcttcggaatcgaccgcagcgcatggaaactcacctcctggccgtcggcgtagagctcctcgagctcggccagcacctcggcgtacacgtctggatggcggatcaactcgatcagcgtccacgccgaggtcccggaactggtgtggtgcccggcgaacatcagcgagatgaacatcccggtgatctcgtcggcggagaaccgcggcttgccgtcctcgtccttgatcgacaccagcacgtcgagcatgtcgcggtcggccttgtccttgggcgggttggccagccgctggtccatgatctcctgcaccagcgcaacgagtttcacccgcgcctcgtcgcgtcgtttgaagctctcgatcggcaggtagggatcgacgtagcacagcgggtcggtgccgcgttccaggtcgtggtagtactcggcgaaccggtggtcgagctgctcgcggaacttcagcccgatcaggcacgccgtcgaggtgtagatggtcagctcggcgaagaagtcgagcagctcgatctcgccctcgtccccccagtcggcgatcatcttcttgacctcgccctcgatggtgctggcgtggcccttcatctgctcgccgcgcagcgccgagttgtgcagcatctccttgcgccgctcggggctggcgtcgaacaccacgcccttgccgaagatcggcgtcatgaacggatacgcctcggcctggtcgagatcctcgtcggcggagcggaagaagaactcgttggcctgggcgcccgagagcaggatgacgtgcttgtccaccagctggaaccagccgacgtcgccgcactcgtcgcgcacgcgctgcatcaaaccgattgggtcggtgcggaattcctcgaggtggccgtgttcttcctcgccgccggaaatccggggcaccacagtgctggtcgtcattgtcctggcatcccctcttcgccgagtgcgagcttctggcgatccttgttgtccgccaacggcgcttcgggctgaagctccatgttcgcgatgaagccgccgcgcggtgtctcggcgacgaacgtgatggctcgcgccaggtccgccgcgcgcaggaagtagtcgtggcgtgcctggccccatttggcccagtcctccagggccgggccgatcttctcggccggcaggctccatcccatcgccgtcttcgtcgggcccgggtgcacgaccgaggcccgcaccccggtgccctcgagctccatctggaagttgttgaccatcgccaccagcgcggccttggccgcgccgtaggcgcccatgtgcggccgctggcgcagggccacgtcggagccgacgaagatcaggtcgccgcgttgccgctcgagcatgcccggcagcacggccgaggccaaccggaaggcgccgaccagatgtatctgcagttgcgactcgaattcgtcgcccgcgatctcggcgagcttgccgaagtaggtgtcgcccgcgccggcgaccagcacctcaatgtcgcccagcgcgtccaccgcctgtgcgacaaaggatttcaccgagttcgggtcggtgacgtccaggtggaatcccaccgcttcgccgccgtcggcgttgatcttgccgacgatgtcgttgagcttctccacccgccgggcgcccagcgcgaccgggaagccgtgcgccgcgagctcgatcgcggtggcctcgccgatcccggaggaggccccggccacgatggccgggcgacgttcgggcaacggatcaaaccggggcattcagcggacctccacgctcatgggtaggtgagcgaatccgcggacattgctggagtggacgcggacggcgttggcctcgtccacctcatatccgcggattcgcttgaacaactcggtgagcgcaacccgggcctccatccgcgccagatgcgcgcccaggcagaagtgtgcgccactaccgaaactcaacagtttgggcccgatttcgcgcccgatcagataatcgtcggggttgtcgaagacccgctcgtcgcggtgcccggacccgggcaacagcagcaggacgtcgccctcgggaatggtggtgtcgtacagggtcagcggcccggagacggtgcgggccaggatctggctggaggtgtcgtagcgcaacgtctcctcgacccacaacggcacccgggacaggtcgtcgtagacgggcgtcagctggtcggggttcttgtggccccaaaacgcggcattggcaagcagtttggtggtggtctcgttaccggcgatcaccatcaggaacatgaacccgagcacctcgtcgtcggtgagccgatcgccgtcgatctcggcctccagcagcgccgacgtcaggtccccggtgggcttcttgcgccgctcctcgaccatcccctggtaatagacgatgaggttgagcgaggcctcgaccgcctccggcggcacgtcggtgaccccctcctcgcggtgcatcacgccgtcggcccaggcccgcacctgaactcgatcggcctggggcacacccatcagctcggagatgacgtccatgggcagcttgccggcgaattcgtcgacatagtcgacggcgccgccggccgcagagcccgccttgtccagcatggtgtcgaggtgctgggtggcgatctcggtgacccggggctccagttcgcgaatccgcctgggcgtgaaccccttcgagaccagcgtgcgcagccgcagatgggcggggtcgtccatcgccaggaacgacatcgtcttggaggcgtgcgggccgcgggacgccgggtccagcgagacgccgtacttgttggaaagcgttgtgctgttgcggaatccctgcagcacgtcttgatgccgggacagcgcccagaacttcagttcgtcgttgcggtacaggggggcctcatcgcgaagccgcttgtagtacgggtaggggtcttcgtggaagtcgtaatcgtagggatcgagcaccaactcgtggtcgcccacatggacggtcatcgtgtgtctccagcctctgtctctgggcttgcctgtgtggtgccggtcaggatgagccgcaccacgtaggccagccgatcggcgatctcgcggtagctgaactcgccgctgccggcctggaccagcgcgccgaagaacgacatctccagcgccgacaccgtggtcgggtcggcgtcggggcccatcgccgaggtgatccggcggtggatctccaccccgatccggtcgcgcgccgcgcgcaccgcgggatcggcgccgccgctgagcaatgccgtcgtgcaggccgcgctcacctccggctcgtcggcgaccaccagggccaggtgccgcagcacctgttcgacccgggtcggcatcgggtcgttgacgtcggtgaagtaggggacctggcgcaccaggtccaggtagacctcggcgatcaggtggttcttcgacgagaagtaggtgtaggcggtggcgggggcgaccttggcgcgggccgccaccgcacgcaccgtcaggtcggagtaggacttctcccgcagcgtttcgatcccggcggcaagcaccttgcggaaggtctcctcctggcgccggttgcgcggcggctgaccggtctcaccgccggcgtcggatgtgatagtcaccagggcgtcgctggacacatgtccaagctagcggacgggttcgccacgaagcaagcccgatccggaaagacaccggttaatcagctgttttcgcgccgtttcgggtggcttgccgcgatcgccccttgcaccgcctgtgggcgggagactatggttcgatcggacaatatcggacaactgtccactagcttggcgggccggcttcgacggtcgcgcagacgggagcacgagatggccttgctggccgacggcgtgagtgaactgttcatcgacggcaagatgtcggccggcaacgccggcaccttcccgacggtcaatccggcgaccgaggaagtgctcggtgtggccgccaacgccgacgccgccgacatggaccgcgcgatcgacgccgcgcggcggacgttcgacgagacggactggtcgcgcaacaccgagttgcgggtgcgctgcgtgcgccagctgcgcgacgccatgcgcgaacacatcgaggaactccgcgacatcaccatcgccgaggtcggcgccccgcggatgctcacctcggccgcccagctggagggtccggtcggcgacctgagcttcgccgccgacaccgccgagtcctacgagtggaatcaggatctcggtcaggcatcgccgatgggcatccccacccggcgcaccatcgcgcgggaagccgtcggtgtggtcggggcgatcacgccgtggaacttcccgcaccagatcaacctcgccaaactggggcccgccctggccgccggaaacaccgtcgtcctcaagcccgcgccggacaccccgtggtgcgccgcagtgctcggtcaactgatcgccgagcacaccgacttcccgcccggcgtcgtcaacatcgtcacctccgacgaccacggcgtgggagcgctgctgtcgaaagaccctcgggtggacatggtttcgttcaccgggtcgacggccaccgggcgcagcgtgatgagcgatgccgccgccaccatcaagcgggtgtttttggagctgggcggcaagtcggcattcgtggtgctcgacgacgccgacctgggcggcgcgtgctcgatgtcggcgttcaccgcggccatgcacgccgggcagggctgcgccatcaccaccaggctgctggtgccccgcgaccgctacgacgaggccgtcgccgccgcggccggcaccatgggatcgatcaagccgggcgatcccaatgaccccggaaccgtttgcggcccggtgatttcggcgcggcaacgcgaccgggtgcaaagctatctcgatctggcgatcgccgagggcggcacgttcgcctgcggcggcggccgcccggccgacaaggacgtcggcttcttcatcgagcccaccgtcatcgcgggcctgaccaacgacgcccggccggcccgtgaggagatcttcggcccggtgctcaccgtgatcgcctacgacggggaggaggacgccctgcggatcgccaacgactcgccatatggcttgtccggcacggtgttcagcgccgatccggaacgcgccgccaacttcgcgtcccggatgcgggtgggcaccgtcaacgtcaacggcggtgtctggtactccgcggatgcgccgttcggcggctacaagcaatccggcaacgggcgcgaaatgggcctggccggcttcgaggaatacctggaaatcaagaccatcgccacggccgtgcagtgaccgcgccgcgcggctgaccgagaggaaatcatgcgattcgagaacaaagtcggcatcgtcaccggatccgggggcggcatcgggcaggcgtacgccgaggcgctggcccgcgagggcgcggcggtggtggtcgccgacatcaacgccgaggcggccgaggccgtcgccaaacagattgtcgccgacggcggtacggccatcagcgtcgcggtcgacgtgtccgaccccgagtcggccaaggcgatggccgaccgcaccctggccgaattcggcggcatcgactacctggtcaacaacgccgcgatcttcgggggcatgaagctggactttttgctcaccatcgacccggagtactacaagaaattcatgagcgtgaacctcgacggggcgctgtggtgcacccgcgcggtgtacaagaagatgaccaagcgcggcggcggggcgatcgtcaaccagtcgtccaccgcggcctggctgtattcgaactactacggcctggccaaggtcggcatcaacggcctgacccagcagctgtcccgcgaactgggcgggcgcaacatccggatcaacgcgatcgcgcccgggcccatcgacaccgaggccaaccggaccaccacacccaaagagatggtcgacgacatcgtcaagggacttccgttgtcgcgcatgggaactcccgacgacctggtcggcatgtgcctgttcctgctgtccgacgaggcgtcgtggatcaccgggcagatcttcaacgtcgacggcgggcagataatccgatcatgacgacgaacgcggcgcacacgaccgagcagctgaagctcggctacatcgggctgggcaatatgggcgcgccgatggccacgaggatgaccgaatggccgggcggggtaacggtttacgacatccggatcgaggcgatgacgccgctggccgaggcgggcgccacccttgccgacagcgtggccgacgtcgccgccgccgacctgatccacatcaccgtgctcgacgacgcccaggtgcgtgaggtggtcggcgaattggccgggcacgccaagcccggcacggtgatcgcgatccactcgaccatcagcgacaccaccgccgtcgaactggcccgcgatctcaaggcgcgggacatccacatcgtcgacgccccggtcagcggcggcgcggccgccgccgcccggggtgagctcgccaccatggtgggcgccggccgcgaggtctacgaacggatcaagccggcgttcaaacactgggcggcggtcgtcatccacgccggtgaaccgggtgcgggaacccgaatgaagttggcccgcaacatgttgacgttcacctcgtatgccgcagcgtgcgaggcgatgaagttggccgaggcggccgggctggacctgcaggcgctgggccgggtggtgcgtcataccgacgcgctcaccggcggtccgggcgcgatcatggtgcgcgacaacatgaaagacctcgagccggacaacttcctctaccagccgttcttgcacacccgcggcctgggggagaaggatctgagcctggcgctggcgttgggtgaggcggtctcggtcgacctgccgctggcccggctggcgtacgagggactggcggccgggctcggcgtgccacacacggagaaagaggcgtgatggacgaacggcggcgcaagggcctcgagaagatgaacgaggtctacggctgggagatgcccaacgtcgagggcgacgcgtatttcgacctgaccgtcgaccacctgttcggcagcatctggacgcggccgggcttgtcgatgcgcgacaagcgcatcatgacgctgacggcggtgaccgcgatcggcaaccgcgatctggccgagatccagatcaacgccgcgctgctcaacggcgagctcaccgagaccgagctcaaggagatggccgtcttcctcacccattacctcggtttcccgctgggctcggcgctcaacggcgcggtcgacgccgtggtggccaagcgcaggaaggccgcggccaagggcgccggcgaggacaagaaggccaacgtggacgccgcattgaagatgcactcgggcggtgagcggggctgatcgcccgctagagtggcgtgtcgtgcgcgtcctggtgatcggctccggtgcccgtgagcatgcgctgctgctggcgctgcgcaaagacccgcaagtcaccgggctggccatcgcccccggcaacgccggcaccgcccggctggccgagcagcacgacgtcgacatcacctcggcgcccgacgtcgtggctctggcccgcgcggtgcgcgccgacctggtggtcatcggccccgaggtgccgctggtcctcggagtcgccgacgcgctgcgggcggccggcatcgtgtgcttcggaccgggcaaggacgccgcccgcatcgaaggctccaaggcgttcgccaaagaggtgatggccgcggccggggtccgcaccgcggccagtgaaatcgtcgatacccccgcgcatttggacgccgcgctggaccggttcggcccgccggcgggcgaggcggcctgggtggtgaaggacgaccggctggccgcgggcaagggcgtggtggtgacagccgaccgcgaggtggcgcgcgcccacgccgccgcgctgctggaggccggccacccggtgctgctggagtcgtttctggacggcccggaggtgtcgctgttctgcgtcgtcgacggcgagaccgtggtgccgctgctgccggcgcaggatttcaagcgggtcggcgacgccgacagcggacccaacaccggcgggatgggcgcctacgcccccgtgccgtggctgcccgatcgggtgtatcgcgacatcgtgcaccgcatcgtcgaacccgttgcggccgagatggttgcgcgtggctgcccgttcagcggattgctgtacgccgggctggcgatcacctccaacggaccggccgtggtcgaattcaattgccgcttcggcgatcccgagacccaggcggtgctggcgctgctggagtcgccgctcgggcagctgctgtacgcggcgggcagcggcaccctggcggacttcggtgaactgcgctggcacgacggtgcggcggtgacggtggtgctggcggcggcgaactatcccggacggccccgggtgggcgacgtcatcaccggctcggaagccgagggcgtgctgcacgccggaaccgcgcgacgcgaggacggcgagatcgtctcctcagggggccgggtgctgtcggtggtggggacgggccccgacctggcggccgcgcgggccaaggcataccagatcctcggctcgattcggttgccgggcagccattttcgcaccgacatcgcacagtcggcggccgacggcaagatccgggtctaaaacgcggcggcctggccgtcgcggcgcgggtcgctggccgcgacgtagccggtatccatccgccagatcgcctggcagctgccgaactggttgtagtcgtcgaccgccaccagatcgtgtccgcgccggcgcaactcgtccagcgtcgcggccgggaaaccgttttcacagctcacctgcgtgccttgcacccagcggaaccgggggccgtcacaggccgcctgcgggttctggccgtggtcggcgatgcgcaccatcacctgtacgtgtccctgcggctgcatcatgccgcccatcaccccgaagctcatcaccggcgcgccgtccttggtcacaaagcccgggatgatggtgtggtagggccgcttgttcgggcccacactgttcggatgaccaagccccgcagtgaaattcgcgcctcggttctgcagcgagatcccggttcccggcaccaccacccccgacccgaagcccatgtagttcgactggatcatcgacaccatcatccccgcggcgtcggccgcggtcagatacaccgttccgcccgccggcgcgcccgccgacaccggcttggcccgggcggggtcgatcagcgccgcccgttgctcgaggtattcggtgtccagcaggcgttccggccgcaacggcatgtgctcgatatcggcgaggtaggcctgggcgtcggcgaaggccagcttcaccgcctcgatctgcaaatgcacgctgtcggcggaatcgactggcagcgaagccatgtcgaatcgctcgaggatgcccagcgcgatcagcgcgacgatgccgtggccgttgggcggaatctcgtgcacggtgtagccgcggtagtcgccggtgatcgtctccacccagtcggcgcggtgggcggccaggtcgtcggccgtcatggcgccgccgttggccgccgcgtgctccgcgacgcgggcggccaatgcgccgcggtagaacgcctcaccgcggcttgcggcgatggcctcgagcgtgtccgcgtgcgcgggcagccggaaccgctccccgggcctgggggcccgaccctcacgcgcgaacgccttagcgaaacccggctgtccggcgaacagcggcacctgcgccgcccattgctccgcgaccacgggcgataccggaaagccgttgcggccgtacgctattgccggtgcgaacagccgctcgaacggcagcttgccgaagcgtgcgtgcagttcggtccacgccgacaccgcaccgggcacggtgacggaattccagccgaggacgggaacggcgttgccgccgaagtattccggggtccacgccgccggtgagcggccggaggcgttgaggccgtgcaccttctcgccgtcccagacgatggcgaacgcgtcggagccgattccgttggaaaccggttccatgatggtcagcgtgatggcggtggcgatggccgcgtcgaccgcgctgccgccctcggcgagcatccgcagacccgcttgggcggcaagcggttgcgatgtgcacaccacgttgtcggccaggaccggcttgcggggccaggcgtacgggaagtcccatccgaacggttggttcaccttcgcgagcgtaacgccggcgtgaggcccggcgccgagcgccacgctggcgtgacgcccggcgcccagcgccgcgctggcgtgacgctcgcgggccccggtgcgatcaggccgtcagcagcggggccatccagctcagctcggccggcaactgcgaactccagaattccgggttatggccgccgggcgagaacccgccggcgggcggattgggcagctgtgcaatgaattgctttgtcgcagcgtaaaacgggtcgctgtcgccgcaatccacccggatcggggtcgatcccagcgcgggcatcccgaacaccgagttggccgcgaagtcgtcgggtccgtcgaaggcccccggcgcggccgcacccgaggacagccacagcgccgggctcaccgcgcagatcgccgccgtccgcgccggcccaagccggccgccgagcagcagcgcgccgtaacctcccatcgaccaacccaggaacgccacccgcgaggtgtccaagccctggttgcccagcagcgggatgagctcgtcgagcaccatcgcgccgctgtcctcgccggaagaccgcttgtgccagtaactgccgccgccgtcgaccgcgaccaccgcgaacggcggcagcccggcattgacggcctgggccagaccctgctcgacgccgccggccatcactgtcgcggcgtcactgcccttgccgtgcagcgcgatcacgggccgcagcggtttggtctgacccggcggacgcgcgatggcccagttggtgttgaccccgccgcgcgcggccgacacgaacgagccggtgaccatggtgggggcggccgccgccggcggagccggatcgcggggcgggcccggggcgggcggtgggggcgccagtggcgtcccggtgccggccgccggcatggcctgagatgcccggggttgtaacaggatgtcgagcccgtagacgcccaccgcgcccacggcggcaccggcgccgagacggagcacggcgcgtcggctcaagtcgggcatgcgggtcatcatgccatgtccgttcggcgggtcgtttggtcgaaatggcaatgcagtaccactttggctggcacgatggctactcgtgactgcagcggttactccaaaaggagaacgccggcggtacgcgctcgtgagcgccgccgccgagctgctggccgagggtgggttcgaggcggtgcggcaccgggcggtcgcccggcgggccggattgccgctggcatccaccacctattacttctcctccctggacgacctgatcgcccgcgcggtcgagcacatcgccatgatcgaggtggcccagctgcggtcccgggtcagcgccttgtcgcggcgccgccgcggaccggagaccatcgccgaagtgctggccgacctgctggtcggcgacgtctccggcccgggcctgaccgagcagctgatctcgcgctacgaacggcacatcgcctgtacccggctgcccgcgctgcgcgagaccatgcgccgcagcctgcgccagcgcgccgaggcggtggcggaggccatcgaacgctcgggccgctcggtgcacatcgacttggtgtgcaccctgatctgcgccgtggacggctcggtggtgtcggccctggtggagggccgggatccgcgggcggcggcccagggtgcggtggtcgacctcatcgaggtgctggccccgatcgatcagcggccggtgcagatctgagcgattgccggcgggccgccggcagcgacggcgtcacgatgcagccggtgccggggtcgccgtagctggtcaccgcgtccgggcggcgctgggcgaacagcgccacataggcgcagacgacggcgtcgacgggatcctcggcgcggcgcagctcgctcttgcgctgcgcgcattcgacggcccggcgcagcgcgcgccaaccggcgtggcggccgacccgcaccgggaccggggcgtgcgccagccgctccacgcccgccatcagcagcagcagctcggacttgagccgctccaggctgcggccgggcttggccttgtatttcagggtttgctgcaacccgaacagggcgacggtcgcggcgtgcgggtagacctcgatggcgcgccggggccgcggcgaacgcgggtccagcgcgaggcccagcgccgcggccagccgggccgcccgcgggccgtcggcgaattcgggtttcccggtgttgcacgggtgggtgccggcctggaacctgcggaagtcgcggttgagcgcggtctcggcgggacgctggccggtcgggttgttcaccaccagcggcgcatcgaaggcgaccaggcactccccgcgcacgtacgggtcgagcgcggccaggatctcgtcgtcgtcgtggaccgcgcccacgctcaccagctcgcctgcggagtcgatgacggcgacgcccgtcgggttccgccccgcccaggcgaggtcgacgccggcgaagtacatgggtccagactgccgccaaaccgcgaccgcggacgccgttacccggtgaatccgttgcccgccgcggtctcgcggtgctcgagaaaccgtaagctctatgtctgtgagcattccgaatgtgctggctgcccggtacgccagtgccgagatggttgcgatctggtcgccggaagccaaagtggtcgccgagcggcggctgtggctcgcggtgctgcgcgcgcagcaacagttgggtgtcgcggttcccgccgaggcgatcgcggactacgagcgggtactcgaggacgtcgatctggcctcgatcgcggaccgcgaacgcctgctgcgccacgacgtcaaggcccgcatcgaggaattcaacgcgctggccggccacgagcacgtgcacaagggcatgaccagccgggatctgaccgagaacgtcgagcagctgcagatccggcgctccctggaactggtcttcgcccacggcgtcgcggtcgccgctcggctggccgaacgggcggtggcctaccgcgatctggtgatggccgggcgcagccacaacgtcgccgcccaggccaccaccttgggcaagcgattcgcctcggccgcccaggagacgctgatcgcgttggcccggctgcgcgagttgatcgaccgttacccgttgcgcggcatcaagggcccgatgggcacgtcgcaggacatgctcgacctgatcggcggcgacccggccaagctcgccgaactcgagcggcgggtcgccgaattcctgggtttctcaatggttttgaccagcgtcgggcaggtgtacccgcggtcgctggaccacgacgtggtctccgcgctggtgcagctgggcgccggcccctcgtcgatggcgcacaccatccggctgatggccgggcacgaactggtcaccgagggattcgcgccgggtcaggtcgggtcgtcggcgatgccgcacaagatgaacacccgcagctgcgaacgggtcaacggcctacaggtggtgctgcgcggctacgcctcgatggccgccgaactggccggcgcgcagtggaacgagggcgacgtgttctgctcggtggtgcgccgagttgcattgccggacagcttctttgccatcgacgggcagatcgagacgtttctgacggtgctcgacgagttcggcgcctacccggcggtgatcggtcgcgagctggaccgctacctgccgttcttggccaccaccaaggtgttgatcgccgcggtgcgcgccgggatgggccgcgaggccgcgcatcacgtgatccgcgagcacgcggtggccacggcattggcgatgcgggaacacggcgccgagcccgacctgttggagcggctggccgccgacgagcggctgccgctggaccgggcggccctggacgccgcgctggccgacaggcgggcgttcaccggcgccgccgccgaccaggtggacgaggtggccgcccaggtggacgccctggtgagccgctacccggacgcggccaagtacaccccgggggccatcctgtgactctcgccggcacgctttcgcagatcgacttcaccgatctggacaacttcgccaacggatttccgcaccacctgttcgccgtgcatcggcgcgaggcgccggtgtactggcatgagccgacggacaacaccccggacggcgagggcttctggtcggtggcctcctatgcggaaacccttgaggtgctcaaggatccggcgacctactcgtcggtgaccggtggtgaacgcccgtacggcggcacgctgctgcaggacctggcgatcgccggccaggtgctcaacatgatggacgatccgcggcattcccagatccggcggctggtcagctccggcttgacgccgcggatgatccgcctggtcgaagacgacctgcgggccagggcgcgccggctgctggacgcggtggtgccgggcgagccgttcgactttctggtcgacatcgccgccgagctgccgatgcagatgatctgcatcctgctgggagtgcctgagtccgaacggcattggttgtttcaggcgatcgagccgcagttcgatttcggcggctcccgcaaggcggcgttgtcgcagctgtccgaggcagaagccggttcgcggatgtacgagtacggccagcagttgatcgccgccaagcgcgccgagccgaccgacgacatgttgtcggtggtcgccaacgcgacgctggatgacgctgcggcgccggccctttccgacctcgagctgtacctgttcttcagcctgttgttcagcgccggggcggaaaccacccgcaatgcggttgcgggcgggctgctggcgctggccgagcatccggagcaattgcgttggctgcgtgacgatctgggggcgctgccgacggccgtcgaggagatggtgcgctggacctcgccctcgccgtccaagcggcgcaccgccacccgcgatgccacgctcggcggccaatcgatcaaggccgggcagaaggtgcagatctgggagggctcggcgaatcgcgacgccagcgtgttcgaccgcgccgacgaattcgacgtcacccgaaaacccaatccgcacttgggttttggtcagggtgtgcactactgcctgggcgccaacctggcccggctggagctgcgggtgctgttcgaggagttgctgtcccggttcggcgcggtgcgggtggtccgtccggtcgaatggacccgcagcaatcggcacaccggcatccggcacctggtcgtggaactccgcgcagaacagtgacgggccggttcgccgacgtcgaggcacgggcgctgccgctacatcccgcggatcgcgataccggccgactgtaattccagcgcggccagcgcccggatggtggcgggatcctcgcgtcgccaaccgccgaccgggtccgcgctgacggcggtcaacttccgtggcgggcggttcgccagcgcgcgcagcgccagcaattgggtgccggccggggtggcggccaacgcggtgaccgtcagcttgcgccgaaagaagcgaagccgcaggaacaaccacggccccaccgcgaccaggatcggcagcgccaccactgccatcgccagcagcaccgccagccagctcgccgccacgtccaggtcgtgaccggcgccggccatgtccagcccggcctggctggcggagttgagcggcttgctgacggtatcgcccaccaccggaatgtgctgggcgccgtgaccggcggaggccaggttgccggcgacgccgtgcgcgccgctctcgacctgccggccggcgtcggcgatggtggcgatggcgtcgtaaaccgccagcccgaccaggatccacagtccggtccagatgacgacggcgaggtcgctgaacagctgggcggccagccgcccgggcctggtggagtagggcagaaaccgcggtgtcatagcctcgatcccagcacacggccggcgtcccggtgcccgataggctgaccggatgcctgcactgtcggactaccagcatctggccagcggcaaggtccgtgagctgtatcgcgtcgacgacgagcacctgctgttggtcgccaccgaccggatctcggcgtacgacttcgtgctggacagcaccatcccggacaagggccgcatcctgacggcgatgagcgtctttttcttcggcctcgtcgatgcccccaaccacctggccggaccgcccgacgacccgcgcattcccgacgaggtgttgggccgcgcgctggtggtgcgccagctcgagatgctcccggtggaatgcgtggcgcgcggctacctgacaggctcggggctactggactaccaggcgaccggcaaggtctgcggcatcgcgttgccgcccggactggtcgaggcgagcaagttcgccgagccgctgttcaccccggcgaccaaggccgccctgggcgaccacgacgagaacatctcttttgcccgggtgatcgagatggtcggcggggtgcgggccaaccagctgcgcgaccgcacgttgcagatctacgtccaggccgccgaccacgcgctacggaagggaatcatcatcgcggacaccaagttcgagttcggcaccgacccggatggcaatcttctgctggccgacgagatcttcaccccggactcctcgcggtactggccggccgacgaataccgggtcggcgtgccgcagaccagcttcgacaaacagttcgtccgcaactggctcaccagccccgaatccggctgggaccggcacggcaccgaaccgcccccaccgctgcccgaccacatcatcgaggccacccgcaaccgctatatcgaagcctacgaacgcatttccgggctgcgtttcgacgactggatcggtccgcgcgcatgaccgagacccacctggccacctccgtgccgcccgtcgccaagcgggtggacacccgccgcgagcatcacggcgacgtcttcgttgacccctacgagtggttgcgggagaagaccgaccccgacgtcatcgcccacctcgaggcggagaacgactacgcggaccggatgaccgcccacctggcgccgctgcgccagcagatcttcgacgagatcaaggcgcgcaccaaagagaccgacctgtccgtgccgacccggcagggccggtggtggtactacgcccgcacctatgaaggcaagcagtatcgcgtccaatgccgttgtcccgtagccgatcccgatgactggaatccgccgaacctggacgaggacaccgagatcccgggcgagcagatcatgctcgattcgaacgtcgaagccgagggtcacgagttcttcgcgctcggcgccgccaccgtcagcctggacgggaacctgctggcgtattccgtcgacaccgtcggcgacgaacgttatacgttgcggttcaaggacttacggaccggtgaactgtatccggacgagatcgccgacatagcggcgggagccacctgggccgccgacaaccgcaccgtgtactacctcaccctggatgcggcacaccgtcccgacaaggtgtggcggtaccaagcgggctccggcgaggcgcccgaactggtgtatcacgaagctgacgagaagttctggctcggcgtgggtctcacccggagcgaggcctacgtcatgatcgcctcgggctcctcgatcacctccgaattccgctacgccgacgccgccgacccgcacgcgcagttcaccgtggtgctgccgcgccgcgacggtgtcgagtactcggtcgagcatgcggtggtcggcgggcaggaccggtttttgatcctgcacaacgacggcgcggtgaacttcaccctcaccgaggccccggtcggcgatccgacccggcagcgcaccctgatcccgcaccgcgacgacgtccggctcgacgcggtggacgccttcgaaggccaccttgtcatcagctaccggcgtgccgcgctgccgcggctgcagctgtggcgcatcgacgccgacggcacatacgcgcggcccgaagagatttcgttcgactccgagctgatgtcggccgggctggccggcaacccgaactggtcggcgccccggctgcggatcagggccggctcgttggtcatcccggcgcgggttacgacatcgacttcgtcaccggggagcggagcctgctgcgcgagcaacccgtgctgggggattaccggcccgccgactacgtcgaacggcgcgactgggccgtcgccgacgacggcacccgcgtcccggtgtccatcgtgcaccgtgccgacattgaattccccgctcccgcactgatttacggctacggcgcctacgagatctgcatcgatccgagcttctccatcgcccggctgtcgctgctggaccgcggcatggtgttcgcgatcgcacacgtgcgcggtggcggcgagatgggccggctgtggtacgagcacggcaagcttctggagaagaagaacaccttcaccgacttcatctcggcggcaaggcatttggtggaatcgaatgtcacccggccggatcggctggtggcgctgggcggcagtgccggcggcttgctggtgggggcggtggccaacctggctccggagctgttcgccgggatactcgcgcaggtgccgttcgtcgatccgctgaccaccatcctggatccgtcgctgccgctgaccgtcaccgagtgggacgaatggggaaacccactggcggacaaggacgtctacttctacatgaagtcctactcgccgtatgaaaacgtcgaggccaggcggtatccggcgatcatggcgatgacgtcgctcaacgacaccagggtgtactacgtggagccggcgaaatgggttgccgcactgcggcatgccaacccggccggcggcccgttcctgttgaagacccagatgaacgccgggcacggtggcgtcagcggccgctacaaggcatgggaggaaaccgcctaccagtacgcgtggctgctagcggccgccgagggcgaccgctacggcggcggccagaaagacgatctccatcccgatccgcaggggtagccgggtcgtcatcgatttgggcgggtcgggcatccgcgaggcgtggatgttggccgggaacatggccagcatcaacaccagcaggcagccggccgcggccgcccgggttgccggcagcaacaggccgagcgcgcccagcagctcgagcaccccggtgagactgaccagcaggccgggtgcgggcagccggggcggaacaatggcgaccaggtccgcgcgcagcggcggcgcgaagtgcgcgatcccggtcagcacgaacatcgcggccagtccgacggccagcgccggggcccaaccgtcgacgtaggccacgcccagccggcccaccacccacgcgaccaggctgcccaccaccagggtgatcaacggcgccatcccaacctcccgcaatctagacactgacaagatctcagaccgccgaagctaccctcggtatctagtcattgtcaagatacgcggtatgctggccggatgacgcgccacagctaccaccacggcgacctgcccgcggtgatcctggccgaagccgcgcggctggtggccgagcgcggcgccgagcgcgtctcgctgcgcgagctggcccgctgcgccggcgtctcgcacgccgcgccggcgcatcacttcaccgatcggcgcgggctgttcacggcgctggccacccagggctttgagctgttgacccaggcgctggccgacgcgcggggcgatttcgccgatgccgccctggcgtatgtgcagttcgccctcgaccaccccggccactaccaggtgatgttcaacaggtcgctgctcgatgcgtccgacggcggcctggccgccgccgaggcggcggccggtgcggagctttcccgcggggtggcgacgttgcgcgacccgcatgcccgggccgacccgcgcggcgccgaactggcggcgtggtcgctggtgcacggtttcgccacgctgtggctcaacgacgccgtcgacgccgcggtccgggcggccgatccgatggacacggtccggcggatcgcgacgatgctgttcgccggctgaccgggtcagtcgccggcgggcgggctcggcggcttccgggggaggaaggacgccggaatgatggtgcaggccaccagcacgacggccagcacgaagacggccgtgtaggcgtgcgacaggtggtgcgacacgtggccggccagctcgggggtcatggccgggcgcggcacggtcgacggatccaccggcaggccgcgcttgccggtgaccgggtgcatcccggccgcctcgttcgccgccatcagggccgggttgcggttgaactggttggtcaggatgaccgccatgagcgcggccccgatcgacccgccgacctgctggttcacgctgatcagcgtggtgccgcgggcgacttgatgcggcgccagcgcctgcatcagcgccgccgacagcggcgtggtggtcaggccgatgcccaggcccatgatcgcgagcccgcacaccaggaccggcgaatacgcggcctgcctggccacgccgtaggtgaacaccgccagacccaccgccatcagcggcagaccggtcagcacgatcttgccgggcccgtgtttgtccatgacggccccgccgagcggcatggtcaacacagcgccgacaccgatcggcagcatgtgcaggcccgactgcatcggcgtctcatggccgacgatctggaagtagctcgggaccagcaacccgacgcccaccgaggcggccgcgaacaccagcagcgtcacattgacctgcgtcaccaccgggttccggaacagccgcaggtcgatcagggggtgctcggtgcgataccaggcgtgcaggatgaacgccgcgatcaacaccaggccgaccagcgccggcaccagcacatagcggtcggccaccgtgtgccgtcccggaatggaacacaccccgcacaaaaagatcgccacgcccggtgacagcagcagcgcgccggtgatgtcgagcgcctccgagggggccgagcggtccttggggaacaagagcgccgccagcgcgaaggcggtcagcccgatcggcaggttgatcagaaagatccacttccagccgtaggccccgatcagccagccgcccaggatgggacccccgatcgggccgagcaggatggggattccgcccaccgccatcagccggccgacccgcttgggtccggcctcccgcgtcaggatgacgaagctgagcggcaacaacatgccgccgccgacgccttgcaccacgcgaaacaggatgagcagcaatatgtttggcgccaccgcgcacagcagcgagcccagcgtgaaaatcagcaccgagcccatgaacaggcgtttggtgccgaaccggtcggccgcccagccggtgatcgggatgaccgtggcgaaggccagcatgtagccggcgatcgtccacgagacgatggcctggttgacgccgaactgtgcgatgaacgttcgttgggcgacggccacgacggtgctgtccagcacggccatgatgcaggccagcccgcagaccccggcgatccggaacagcgcggcatcgagcttgtcggggtactcgtcgtcgcgcagggacggtcccgaggcggtggccaacgggacgctgaaagctgcagaacgggtcttctccatggcgccgttgagcatatccgcagggttgccccggctgaggcgttttacccctattcgcttattcgcacgcgtgtaattcgttttctgtggttaagcgataaacgcgctggtgctgatccggcggcgcgattatgtcatttgccggcggtttcggtggcgggctttttcggcagaaacgacgccggaatgatggtgcaaaccaccagcgcaacggcgatcacgaataccgcggtataggcgtgcgaaaggtcgtgcaacacattgccccaaaaaccgggagcaagcgattgccggggtattgcggattggtcgatcggcgtcccaccggcggccgccttctggtgcagggcggccagcttgttggcggcgacgatgttggggctgcggttgaactggttggtcaggatcatcgacatcagcgcggtgcccatcgagccacccacttgatggctgacgctcatcagcgtcgtcccgcgcgcgatttggtgcggggccagcgcctgcaccgacgcgacggacagcggcatcatggtgcagcccatgcccaggccggtgatcgccagcccggccagcagcgtcggcaggtagggggcctgcctggccaccccgaaggcgaaggcgcccaggccggcggtgatcagcgcgatgccgaccagcaccaccttgcccggcccctgcctgtccaccagcggtccggtcaaccgcacggtcagcatggcgccgagtccctggggaatcatgtgcacgccggcctgcatcggcgtttggtgcagcacctgctggaaatagctcggcagcagcagcccggcgccgaagaaggcggtggcgaagaccagcatcgtcacgttggcgtgggtgagcaccggattgcggaacagccgcaggtcgatcagcggatgatcggcgcgatgccaggcgtgcccgacgaacccggcgatcagcgtcagccccatcgccgccggtatcagcacatgccggtccgcgacggtgccgcggccggggatggacgacaccgcgaacaggaacgtcgccaggcccggcgagagcagcagcacgcccacggcatcgaaggtctccgagcgggctgggtgatcgcggggaaacacgacggcggccagggcgacggtgaggagcccgatcggcacgttgatcaagaagatccaccgccaactcgaggtgtcgatcagccatccgcccaggatcgggccgccgatcggggcgagcagcatcgggatgctcaggatcgacatcagccgcccgagccgacgcggccccgcttcccgggtcaagatcatgaaacccaacggcagcaacatgccgccgccgatgccctgaaccacccgaaagacgatgagctgcaagacgtttgccgctagcgcgcacagcagcgagcccagcatgaaggccagcaccgagccgatgaacagtcgtttggtgccgaaccggtccgccgcccacccggtgatcgggatgacggtggccagggcgagcgtgtagccggtcatcgtccaggccaccacggcctgcgaggaggagaactggtcgatgaaggtgcgctgggcgacgctgacgaccgtgacgtccaggatcgccatcacggtggccaagatgcacacaccggagatccgcagcagcgcggcgtccagcttgtcggggtattcccgttcggtggcgcccggctgcccggtcggggcatgcggcggcgttttggccgctgcgtacggggcctcatccatggcgttgcttagcatatcgaacagaccggattcgccggacccggcggccgccaattcggttatcgcgctgggtgagcgcatatacgcctgctgtctgcgtgtccttcaccattccgacacctgagatcgtcaaactgctggtgtgtctggaaaattgatcgtctccgtctcgggcatcggcgaacgcaccctgcccgacgtggaggcgttctgcgcacaaatggacgcgcgcaacgtgccggtgtcattgctggtggctccccggctgtccggcgactaccggctcgaccacgacccgcgaaccgtcgaatggctgaccggccgccgggccggtggggacgccatcgtgctgcacggctacgacgacgctgccaccaagaagcggcgcggcgagttcgcgattctgcgggcgcacgaggccaacctgaggctgatggccgccgaccgggtgctcgagcatctcgggctgcgcacccggctgttcgccgcgcccggctgggtggtgtcacccggggtcgtcaaggcgttgccgggcaacggatttcgcttgctggccgacctgcacgggatcaccgacctggtccggcacagcaccgtgcgcgcccgggtcctcggcatcggcgagggcttcctcagcgagccgtggtggtgccggatggtggtgctgtccgccgagcggatcgcccgccgccacggcgtggtgcgggtggcggtcgcggctcgccatctccgcaaacccggcccgttgcaggccatgctggacgccgtcgacctggccctgatgcacaactgcgaaccgacggtgtatcgctggcgctccgaccgggccgccctggacgctgcctgaccaagcgagtcgcgcgcggcggccggggcactaccctggtccgacatgagcgattcatcggtggcggctttcggcgcggatgccattgtggtcggggccggattggcgggcctggtcgccgcctgcgaactggtggaccgcggcctgcgggtgcttgtcctggaccaggagaacagcgccaacctgggcgggcaggccttctggtcgttcggcggcctgttcttcgtcgacagccccgagcagcgccggctgggcatccgcgacagccatgaactcgcgctgcaggattggctgggcaccgcggcgttcgaccgccccgaggacttctggccgcgccaatgggcgcacgcctatgtcgatttcgccgcgggcgagaaacgcagttggttgcgtgcccgggggttgaagcttttcccgttggtcggctgggccgagcgcggcggctatggcgcacagggacacggcaattcggccccccgcttccacatcacctggggtaccggcccggcgctggtcgagatcttcgcccgccgattgcgggatcgctcgaccgtgcgtttcgcgcaccgccatcgggtcgacgaactgatcgtcgagggcggcgcggtgaccggcgtccggggcagcgtgctggagccctccgccgcgccgcgcggtgtcgcgtcgtcgcgaaacaccatagcgcagttcgagtttcgcgccgacgcggtgatcgtgaccagtggcggcatcggcggcaatcacgagttggtgcgcaagaattggccgaagcggatgggccgcgtccccgaacaattgctcagcggtgtgccggcacatgtcgacggccggatgatcgagatcacccagcgggccggtgcgcgggtgatcaacccggaccggatgtggcactacaccgagggcatcaccaactacgagccgatctggccgcggcacggcatccgcatcatcccgggcccgtcctcgctgtggctggacgccaacggcaagcggctgccggttccgctctacccggggttcgacaccctcggcacgttggagtacatcaccaaatcgggcttcgactacacctggttcgtgttgaacgccaagatcatcgagaaggaattcgcgctttccggccaggagcagaaccccgacctgaccgggcagagcgtgcgcgaactgctgcgcaaccgggcgcgctccgggccgcccggaccggtgcaggcgttcgtcgaccggggggtggacttcgtcagcgcgaattcgttgcgcgagttggtgaccgcgatgaacaagctgcccgacgtggcgccgctggactacgccacggtggaggccgaggtcaccgcccgcgaccgcgaggtggccaacaggttcagcaaggacggccagatcaccgcgatccgcgccgcccgcggctatctgggcgaccggctgggccgggtggtggcgccacaccggctgaccgacccgaaggccggaccgctgatcgcggtcaaactacatatcctgacgcgaaagacgttgggcggcatcgaaaccgacctcgcctcgcgggtgctgggcgccgacggcaccccactcaccggactgtacgcggccggcgaggcggccggattcggcggcggcggggtgcacggctatcgcgcgttggaaggcaccttcctcggcgggtgcatcttctccggccgcgctgccggtcgcggcgtcgccgacgacatcacctaagaggccgagcgctagaaggtgacggcgtcctcttcgggcagcacctggaagtcggtgctggtcatctccgagagccggccgtagtagatgccgcgcgcgtccggggcgatgatgccctggtggatggggacggcgcgggcgggcgccacggcgcgcaggtagtccaccgcctcggacaccttcatccacggggccgcggccggggtggccagcacgtccaccggctcgtcgggcacgaacagcgcgtcgccgggatgcatcaaccgggcgcgatggccgccgtcgcccaccagaaacgaaatgttctctatcacagggatttccgggtggatcaccgcatgtttaccgccgaccgcgcgaaccgtcagctcgccgatctgcagctcgtcgccgacgtgcaccgcccggcagggtgcgcccagttgggcggtggtctgtgggtcggcgtacagcggggcatccgggttaccctcgagcaatgccggcagccgggtggcgtcgatgtggtcggggtgctgatgggtgatcaagatggcggtgaggccggtgatgccctcgaaaccgtgtgcgaaggtaccggggtcaaagagcactcgggtgtggtcgaactcggcaagtaggcacgaatggccgaaatgcgtcagttgcatatctacgattgtgccttgatggacaagctgccgatgcgcgtcttcctggccaccatggtggtcgccggcagcttcgcggttgccctgatcgtcgtcattcctgcgtacggcgagcccgagacctgcccggggatatgcgaccggatccccaacaccgcgtggatcgatcagcatgcggtgccgctggatgcggtgtaccactggcccgcgctcgccggtcaggcggcgcacaccaccggcgcggcgcccggcccgcgtttccggttcgaggagctgtgcggcgcgccggccctgccgcaggacccgcgcgactcggcggtggtggcgcgttcgacggttgcccatcccgacgggcagtggcagctgcaggcgcaggtgctgcactggcgcggcgacaccgcccacggcggcgccgtcgcggccacggtgttcggcaacgccgtcgccgcgctgcgcggctgccagcagcgcgcgccgcaggaatcgccgtcgctgaccagcgacgagccgacccggatggccgccgtgatcagcggcccggtggtgatgcacacctatctgctggcgcaccctgccagcagcaccatcagcgagctgacgctgtggtcgtcggcgccgccgcagacgccgtggccggcgatggcggacgacccggtgctgggcgccatgaacgcgtcgttgtgcgaggcctacatcgcctcgtgcccgtgatcccgagctgcgctttcgccggtagagttggcgcggaaaacgccaacacaggaggagcgccggtggcccgggtgatcgtgagtgtgatgcccaaagcggagatcttggacccgcagggtcaggcgattgtcggtgcgctgggccggctcgggcattccgggatctcagatgtgcggcagggcaagcgatttgagctcgaggtcgatgacagcgtcgacgatgcggcgctcgccgagatcgccgaaacgctgttggccaacaccgtgatcgaggactggacgatcagccgggagacgcagtgactgcacgcatcgggatcatcaccttccccgggacgctcgacgacgtggacgccgcgcgggcggcgcgacgggtcggcgcgcagccggtcagcctgtggcacgccgacgccgacctcaagggtgtcgacgcggtggtggtgcccggcggcttctcctacggcgactacctgcgggccggggcgatcgcccggttcgccccggtgatgaccgaagtcgtcgacgccgcccgccgcggaatgccagtgttgggtatttgcaacggttttcaggtgctctgcgaggccgggctgctgcccggcgcgttgacccgcaacgtgggtctgcacttcatctgccgcgacgtgtggctgcgggtggcctcgacgtcgacggcgtggacgtcgaggttcgaacccgacgccgatctgctggtgccgctgaaatccggtgagggccgctacgtcgcccccgccgacgtgctcgacgaactcgagggcgagggacgggtggtgttccgctaccacgagaacctcaacgggtcccagcgcgacatcgccggcgtcagctccgccgacggccgcgtggtggggctgatgccgcatcccgaacatgccatcgaggcgctgaccgggccttccgacgacggcctgggcctgttctattcggtgctggacggcgtgctcgccggctgagcgccgggacgtcagcccgcgtcgcgcagcaacggtacgtgcgccggcggtgcggcggggttcaactcctcgaagagttgggtcgcgtccgcgatcgtctcgtcgagaaaagcggcgaaatcggtgaagccgacgccgtttcggatccattgcgacttgcgcgccgtgacgccgatccgctgcggatccgacgaaccgtgcacgatcgcggtgacgcgccggcccagacggttccaccggtcggaaaagtgggtcagccacgggcggtcggacgcggggaagtagtaccccgggctgacccggatgatcaacacgtcgtcgtgcgcgggcgaaatctcgaagtggacatgcagccgccgcggagcggcggtcacgaagaagtattcgccgtcgtggtggccgcgaaaataccgccggccgcgcgtgcgcaagtagcgctccaccaggttcgcgcagctctgctcgttcgtcatgacgaacatgctgccgccggcgaatttgcggacgctgggagccaaccggtgcgccaccgaagaatctgttgagaattcgctgagtcagcggctccgctccacgatcccggcgccccgtccgggcaccgtgcgcggcagcgtgaccgaaaaccggtaccgctccggacgatagtggaactccaccacctcaaggggcgtgtcgtcatggccgtaactggtgcgttcgagcaccagcaccggcgaccccaacggcagattcagggcgccggccacttccacggaggcgccggcggcgtggatctcgtagctggctcgggcgatcggggtgtcgagtcgccgctcccacatggtgtaggtgctttccatcgcccgcccggtctgcgtgtcggtcgcgctcttcagcaacggttcgacggccttgcccaaccccggcggcaggtaggcgatcatcagggccagcggctgctcgccgtcgcggaaacgccggtgcacgcaaaggactttggtcaggtgcagcgtttcggcgatgcgttgcggggcgtcctcgacgcgatgcgacagcacgtcgacgttcggagtgatgcccgaggcggccagcacctcggtgatggtgcgcacgccgggcccgagttcctgcttgaccgggttggccacgaaggtgcccaggccctggcggcgcaccagccagccctggcgttcgagcagcccgaccgccgcgcgcacggtggcccggctcacccgggtgcgatcgaccagctctcgctcggtgggcagccgcgcaccgcgaggcagccgctgtttgacgatggccgccttgagcgcttcggcgagctgggtgctggccggcacgctgccccgggagatccgcaggtcggcggcgtcgaggtcgagctggtcggggaccacgagatgtattaaaacgtctcatttgctggccgtaaagcgcgagcaccgcaagcacgaccgccgtcgccaaccgggtaggcggaaaatattggcgtacaacgggtttcgggtcgccgtggcgtcagtcgggatcggtcagcggatacagcgcgggcaggttgaccacgatggcctcctgggtgctgcgcgcgattaccacctcggcggtggtgtgcgggtcggggttttcctcccggtgcggcaggtaaggcgggatgaagacgtagtcaccgggcgcggtggcgatgcggacttcgtggacaccgtcgtgaaagacgaactccgggttgccggttcgcacatagatcgccgtctcggattcgccgtggtggtggttgtccgacgccgatccgggtaacgcgtgcgtctcacccatccacagcttttccgacccgaccgagttgccggacagcgcggcgaagcgccgcaggccctccgactgtgcggtatcggagctgagctgtgacgccttgacgtgatacacgcggttgcgcgcggcgtgcggtgtcgcgtcgtcgaagtccgggtgaaatccgtccgcggtggccattggttctcacgaggtcagcgggacggcggcctcggcggtgtagcacaagaaggtcagcgtctcctgcaggtacagctgcacggtgtccgcgtcgtgactggtgtagccgatcgacacgtcggtcccgagttgcaggtcgaagtcgccgccgcgggtggtcagcacgaaagcaccgtcgatggccggcgcccagatgatgtcgccgggaaccagccggtcgatgtgttcgaggatcggatagccgtgttcggtggtctcgctgaccttggtgtagacgtcggcggacagcagcaccgagtaggggccgtcgacaccggccagccggagttcggagatcgcctgggtgatcacgtccggaatctcgcgggggtctgccggcagggccagcggcttgttcgagctggccgaacggatgccgtcgatcgacgcggccgcgtagccctcgaagatggcccggtcttccacgaacgccaacttcttggcggcctccttgaccggatcccagtccgagtcgttggcgccgcgctcgacgttgtcgatctcgtaacgcgacaaggtgaacggaacccgcagccggacaaggggtttgctggcccgcaggtgggccaccacaccgttggtgggtgcctcgacgtcgatcagtcggccggtgctgaccgccgcggcggccggaccgccgggctcgctcacgtcgaccacccgccggccggcgacatggcgcttgaaggtccggctggcctccaattcgatttcaccccaagcggcttcggtgaccggtgccagatcgcggtagaggttgttcatcgagttgttcctttcaagctgccgatcgacagtgagccgttccgcgccgggggtgccgccggcgtcccaggcgcgggcaggggtggcgggtcgtcgaggaaatcgacggtgggagagaagaacagtccaccggtgaccgcggtggagaaatcgaggatgcgatcggtgttgccgggcgggtcgccgaggaacatgttgcgcagcatctgttcggtgactcgcggggtgcgcgagtagccgatgaaataggtgccgtattcgctcttgccgagttcgccgaagggcatgttgtgccggacgattttcagctcggtgccgtcgtcgtcggtgatgacgttgagcgcgatgtgggcgtcggcgggtttgacgtcgtcgtcgagttcgatgtcatcgagcttggtgcgcccgatcacgttctcctgctcggtgaccgacagcgcggtccacgccgacatgtcgtgcaggtacttctgcacgtggacgtagcaggagccggcgaagtcggggtcctcgtcgccgatcgcggtggagctgacggccagtgccccgtcggggttttcggtgccgtcgacgaacccgagcaggtcgcggttgtcgaagtaccggaagccgtgcacctcgtcgacgacggtgacggcgccggccatcgatttcaggatccggtcggccagttcgaaacagacgtccaggctttcggcccggatgtggaacaacaggtccccgggtgtggcgggagcggtgtgccgcggcccgtgcagctcgacgaagcggtgcagctcggcggggcgcggcccggagaacaaacggtcccagacgtccgagccgatcgaggcgatcgccgacaaccgcttctgcggctcgcggaaaccgatcgcgcgcaccagccccgagatgtcctgcagcgcctcgtgcacggtcgcctcgccgccgtcgtcgacggtcagcacgaggaagatcgccgccggggtgagcggcgcgaggatgggctgtggctggacggggggcacgtggatgaccctaacgtgaacgccgtgacggcggacagccacgatgttcaccatgtccggcgggcctcgaaaccagacgaagtcctcagcgagtgcgcaagggctctgcgagttcatcgacgcctctccgtcgccgtttcacgtctgcgccacggtggccgctcggctgatcgctgccgggtacaccgaactggacgaggctaaacactggccatcgcagcccggccgctacttcaccgtgcgggccggctccctggtggcctgggattcaaccggcgccgacggcccgttccggatcgtgggcgcgcacaccgacagcccgaacctgcgggtcaagcagcatcccgaccggacggtcgccgggtggcgggtggtggcgctgcagccctatggcggcgcctggctcaactcgtggctggaccgcgacctgggcatcagcggacgcctgtcggtgcgcgacggttccgggctcagccaccggctggtccgcatcgacgagccgatcctgcgggtgccgcagctggccatccatttggccgaggaccgcaagtcggtgacgctggatccgcagcggcacgtcaacgcggtgtggggcgtcggcgagtcggcgcggtcgttcgtcgactacgtcgcggcacgggccgcggtggcgccggacgacgtgctggccgccgacctgatgacccacgacctgacgccctcgacgctgatcggcgcctcggagaacggaacggccgacctgctcagcgcgccccggctggacaaccaggccagctgctacgcgggcctggaggcgctgctggcgaccgagccgagcgggccgctgcccgtcctggtcctcttcgaccacgaggaggtcgggtcgtcctcggaccacggcgcgcactccgacttgctgagcaccgtgctggagcgaattgtgttggcggccggcggtactcggcaggactacctgtcccggctgccggcctcgctgctcgcctcggcggacatggcacacgccacccaccccaactacccggagcgccacgagcccggccacccgatcgccgtcaacgccggaccggtgctcaaggtgcacccgaacctgcgctacgccaccgacagccgcaccgccgcggccttcgcgctggcctgccggcaggccggggtgacgctgcagcgctacgagcaccgggccgacctgccgtgcgggtcgacgatcggtccgctggccgcggcgcgcaccggcatcccgacggtcgacgtgggcgcggcgcagctggcgatgcactccgcgcgcgagctgatgggcgcgcacgacgtcgccgcgtactcggccgcgatgcacgcgttcctttctcccggttagcggcataggctcggccggtatggggctcaacgtggagatggtgaccttcgactgccgggaccccgcgcggctggccggctggtgggccgagcagttcggcggcacgacgcacgacatcctcgccggcgagttcaccgcggtgagcttccccgaggggctgcggctggggtttcagaaggtgcccgatcccacgcccgggaagaaccgcgtgcacctcgatctcggtgtcgccgatctcgacgccgaggtgtcgcggctgacggcggctggagcgaacgaggtcggccggcaccagttcggtgagagctttcgctgggtggtgctggccgaccccgaaggcaatgtgttctgcctggtgcgcccgtagctagaggcgcttggccaacaactgctcggccatctgggcgcccttgcggctgtccgactgcgctttacggaacagctcggcgacgtcgttgtccccttcgcgctcggcgtcctgaatgtaggtttccagccgcaaggcgttgtcgagacacttctcggtgaaccaaatgaggttgtagttcttgtctttggtgccggtgacatgtccggtttcgactgtcattgtctcctccgttttgcgttcgtcctcggacacagggcggctacccgcccaccctgcggacaaaccttcgccgcgggctggccccggcagcggcgccggcaggggcggtgcgccatagactggcgggcgtgactgtctccccgacgagtgcgcccacccaggcgatcgacaccgtcgagcgcgccgcgaccacccccgacgagccgcagcccttcggcgagttgggcctcaaagacgacgaataccagcgcatccgcgaaatcctgggccgccggcccaccgacaccgagctggcgatgtactcggtgatgtggagcgagcactgctcctacaagtcgtccaaggtgcacctgcgctacttcggggagaccaccaccgacgagatgcgcgccggcatgctggccggcatcggcgagaacgccggcgtcgtcgacatcggcgacggctgggcggtcaccttcaaggtggaatcgcacaaccacccctcctacgtcgagccctatcagggggcggccaccggcgtcggcggcatcgtgcgcgacatcatggcgatgggcgcgcgcccggtggcggtgatggaccagcttcggttcggcgccgccgatgcgccggacacccgccgcgtgctcgacggcgtggtgcgcggcatcggcggctacggcaactcgctgggcctgcccaacatcggcggcgagaccgtcttcgacgcctgctacgccggcaacccgctggtgaacgccatgtgcgtcggcgtgttacgccaggaggacctgcacatggccttcgcctccggcacgggcaacaagatcatcctgttcggcgcccgcaccgggctggacggcatcggcggggtatcggtgctggcgtcggacaccttcgatgcggagaactcgcgcaagaagctgccctcggttcaggtgggcgacccgttcatggagaaggtgctcatcgagtgctgcctggagctctacgccggtgggctggtggtcggcatccaagacctgggcggtgccggattagcttgcgccacttctgaattggcgtccgccggggacggggggatggaggtccggctggaggccgtgccgctgcgcaccgccggcatgacgcccgcggaggtgctgtgcagcgaatcccaggagcggatgtgcgcggtggtcacaccggagaacgtcgacgccttcctggcggtgtgccgcaagtgggacgtgctggccaccgtgatcggcgaggtcaccgacggcgaccggctgcggatcacctggcacgggcagacggtggtcgacgtgccgccgcgcaccgtcgcccatgaaggcccggtataccagcgaccgctcgcccgccccgacacccaggacgccctgaacgccgacagctcggcacggctgccccgcccggccaccggcgccgagctgcgggccactttgcttgcgctgcttggcagtccgcacctgtgcagccgcgcgttcatcaccgagcagtacgaccggtatgtgcgcggcaacaccgtgctggccgaacacgccgacggcggcgtgctgcgcgtcgacgagaccaccggccgcggcatcgccgtgtccaccgacgcctcgggccgctacaccatgctcgacccctacgccggtgcgcagctcgcgctcgccgaggcctaccgcaacgtcgccgtcaccggcgccaccccggtcgcggtgaccaactgcctcaatttcggctcgcccgaagaccccgcggtgatgtggcagttcgcccaggcggtacgcgggttggcggatggctgtgtggccctggggattccggtgaccggcggcaacgtcagcttctacaaccaaaccgggtcggcggcgatcctgcccaccccggtggtgggagtgctcggcgtcctcgacgatgtgagccgacggctgcccaccgccctgggcgccgagcccggcgaaaccctgatgctgctcggcgagacccgcgacgagttcgacggctcggtgtgggcacaggtgaccgccgaccatctgggcggtctgccgcccaaggtcgacctggcccgcgagaagctgctggccgaggtgctgcgcgcggcgtcgcgcgacggcctggtgtccgcggcgcacgacctgtccgagggcggcctggcccaggccgtcgtcgaggctgccctggcgggcgaaaccggttgtcgcatcgtgcttcccgaggacgccgacccgttcgtgacgttgttctccgagtcggcgggccgggtgctggtggcggtgccgcgcaccgaggagagccggttccgttccatgtgcgaggcgcggggactgccggcggtgcgcatcggcgtcgtcgaccaggcctccgacgaggtcgaggtgcaggggctgttcacggttccgttggccgaattgcggcagacctccgagtcggtgctgccccggctgttcggatgaacatccgccgccaaacctgatgcggcccagcctttttcgtcgaaccgccgcgctgtcgttggccggcgccctggtcggctggagcttcgccggcccgcggctgccggccggggctcgcatggtgctgcaggccgggatgggtgccgcgctggtggcgctgacgcgggcgccgctgggcctgcacccgccgcggctgtgggccgggttgcggtgcggggcggcggtcgccggctgtgcggcgggcgcggtcgccgcgaccaccctggtgcccgcggtgcgcgagtcgatggccgggcgcgagccgccggccccggcgccggactggctgctgctgcgcataccggtgggcaccgtctggtcggaagaggccgcctttcgcgcggcgctgaccgccgccggctccgccgcgttcggcagacgcggcgcaatgttgttgcaggccatagcctttgggctctcacacatcgccgacgcccgcgccatcggcgagccgctggccggcaccgtgttggtcaccgccgtcgggggctggttcttcggctggctcaccgaccgttgcggcagcctcgccgcccccctgctggcgcatttggccgtcaacgaggccggggcgatcgcggtgctcgcggtgcggcgtcgttccgggcgaaacgcggccccacgaatctgagaccctgggtctatggcgccccgcgacaagcccgacccggccaagacccggcatgcggtgctggccgtcgcgcagtggctgcgggacgagtccgcgcccgagcccgcccgcgacgaggtggcgacggccgttcggctcaccgcccgcaccctggccgcggcggcgcccggccgcagcgtggagctgcgcatcccgccgttcgccgcggtgcagtgcatccccgggcccgcccacacccgcggcacgccgcccaacgtggtggaaaccgaaccgcggacctggctgctgctggtcaccggcaagctggcgttcgccgacgccaggcgcaccggtgcgctgcgcctttccggctcccgcgccggtgagatcgaacactgcctgcccctgttcgacgtggaccgaacataaccctgaagtgcaggtttaccccggcgggccgggatttcgccggtcaacacgcccggcggattcggcggcgcggccgcgctgcccgtagactccgttacgtcaccaaccgttccccggggagccgcccaatcgtgaccgtcgccgaacccgagcaggacttcaacgcaccccgcgaggaatgcggtgtattcggggtctgggccccgggcgaggaagtcgccaaactcacctactacggcctctacgcgctgcagcatcgcgggcaggaggccgccggcatcgccgtcgccgacggatcccaagtgctggtgttcaaggacctgggcctggtcagccaggtgttcgacgagcagacgctggccgcgatgcagggccacgtcgccatcgggcactgccgctactccaccaccggcgacaccacctgggagaacgcccagccggtgttccgcaacaccgccgcgggcaccggggttgccttggggcacaacggaaatctggtcaacaccgccgagctggccgcgcgggcccgcgacgcggggctgatcgccaagcgcgcgccggccccggcgaccaccgactccgacatcctgggcgcgctgctggcgcacggcgccgccgactccacgttggagcaggccgcgctggacctgctgccgacggtgcgcggcgccttctgtctgaccttcatggacgagaacacgctctatgcgtgccgcgatccgcatggggtgcggccactttcgctgggacggctggaccgcggctgggtggtggcctccgagaccgccgcgctcgacatcgtcggcgcctcgttcgtgcgcgacatcgaaccgggcgaactgctggcgatcgacgccgacggggtgcgctccacccggttcgccaatcccacccccaagggctgcgtcttcgagtacgtctatttggcgagaccggacagcaccatcgccggccggtccgtgcacgccacccgggtcgagatcggccggcggctggcccgggaacgccccgtcgaggccgacctggtgatcggggtgcccgagtcgggcacccccgccgccgtcggctacgcccaggaatccggcatcccctacgggcaggggctgatgaagaacgcctacgtggggcgcaccttcatccagccgtcgcagaccatccgtcaactcggtatccggctcaagctcaacccacttcgcgaggtgatccgcggcaaacggctcatcgtcgtcgacgactccatcgtgcgcggcaacactcagcgggcgctgctgcggatgctgcgcgaggccggcgccgtcgaggtgcacgtgcgcatcgcgtcaccgccggtcaaatggccctgcttctacggcatcgacttcccgtcgccggccgaactgatcgccaacgcggtcgaggacaaacacgagatgctcgaggcggtgcggcacgccatcggcgccgactcgctgggctacatctcgctgcgtggcctgatcgcagcctccgagcagccggcgtcgcggctgtgcaccgcctgcttcgacggccagtacccgatcgaactgcccggcgagacggcgttgggcaagaacgtcatcgagcacatgctcgccaacgcggcccggggcgccgggctcgacgacctggcggccgacgaagtgcccgtcgtccactgagcggctcgttcgccgacgtttgataccggcggtcagcgccgaccggtagcctttatcgcgatgacggatcccggaaaaagccccggacgccactcgggcagtcagggcatcacctacgcgtcggccggggtggacattgaagccggcgatcgcgctgtcgaattgttcaagccgctggcgaccaaggccacgcggcccgaggtgcgcggcggcctgggcggattcgccggcttgttcgcgctacgcggcgaataccgcgagccgctgctggcggcctccaccgacggcgtcgggaccaagctggcggtcgcccaggcgatggacaagcacgacaccgtcgggctggacctggtggcgatggtggtcgacgacctggtggtgtgcggcgccgagccgctgttcttgcaggactacatcgcggtgggccgcacggtgccggaacggttgagcgccatcgtcagtggcatcgccgagggctgcgtgcgggccggctgcgcgctgctgggcggggagacggccgaacacccgggcctgatggaacccgaccactacgacatctcggccaccggcgtcggcgtggtcgaggccgacgacgtgctggggccggatcgggtcaaacccggcgacgtcatcatcgcgatgggctcgtcgggtctgcactccaacggatactcgttggcccgcacggtgttgctcgagatcgaccggatgaacctggaaggctatgtcgaagagttcggccgcacgctgggcgaagagctgctcgaacccacccgcatttacgccaaggactgcctggcgctggccgccgaaacccacgtgcgcacgttctgccacgtcaccggtgggggactggccggcaacctggcgcgcgtcatcccgcacgggctggtcgccgagttggaccgcggcacctggacccccgcgccggtgttcgccatgatcgcccagcgcggccgggtgacccgcgaggagatggagaagacgttcaacatgggtgtcggcatgatcgccgtcgtcgcccccgaggacaccgaccgggccctggccatcctgaccgcccggcacctggactgctgggtgctgggcaccgtgggcaaaggcggcaaggcggggccgcgggccaaactcgtgggccaacacccgagattttgaacgagattttgaaatagccgcgccgcggtagaaccaacgcggcgccggtgcagtacgcatcggcgccggattgtcgctgttagcctcgccagccgtcctggtcgtcccagggttggtcggagccgtcggtgtccaggtcgttggagtcgtccgaacccgttcccgacagctcgcgctgaagccgctggaagtcggtctgcggagaactgtatttgagttctcgtgcaaccttggtctgctttgccttagcccggccgcggcccatgggggaaccccctcgcgcaataacggagcggcctaacgagtaggcggctccgatctcctggtgtcgtattgtcctgtcgacagtttaccgtgcctcgccactgggcgtcggcgcccccctgctcgctgtggcggacgttaccgttcattatcccgcaccgccccgcaaccgttcaacggccaaccgcccggcgccgatctgctcggctgcaggcagcgaatcggggtcgatcaccgcggccaccgcggcctgcgggccggttgccagcgcggtgtcggcgggcagcccgcgcttgagcagcgccagggcgatcggcccgagatcgacgtggtcgaccacggtgcccagccggccgaccgcgcgcccgccggcctgcaccggatcacccgtcgcgggccgatccgccgagccgtcgaggtgcagcagcaccagcatgcggggcggtcggcccaggttgtgcacccgcgcgacggtctcctgcccgcggtaacagcccttgtccaggtggacggcgccctggccggggccgccgatccaacccacttcgtgcgggatcgtgcgctcgtcggtgtccatgccgagccgcggccgccgggaggccacccggtgggcttcgtacgcccatactccgccgggccgtactccggcctgcgccaagcgattccgccagtcggcggcctcggcgcgcggaaccacgaggtccagttccagccggccggcggggccggccggcatccggcgcaggaagccgccgcgggtgggcaccgcggccgcctcggcgggcagcgcatccaccccgagcgcgtcgagcacggcccgctccgccagcttcgggccgagcagcgagagcaccgccagatcggcggcggccggggtgacgtcggaccagaacaccatcttgcgcaggtagtccagcagcggcccggcccgccacggctcggtgtcgaggtaggtggtgcccgccagctcggtctggatccagtggtcctcgactcggccctggccgtcgaggctcaggttctgggtgctggccccctcgggcaggtcgctgacgtattgcgtcgagatgctgtgcaaccaggtctgccggtcggcgccggtcagggtgagcacaccgcggtgtgaccggtcgatgaccagcgcctcggtctcggccgcgcgctgctcgcccaaggggtcgccgtaatgccagacggcgcccgcgtcgggtccggtgtcgggggcggggactgggtgggtcacgagtcaactctacggaccgcgcgcggcccgcctcgggtgtgcggccggcttcacactcggcgggcgacggcgagccgataggcttcacgaccatggctggccggacgggagtgatcgtcacgctggacggcgaggtgcatgcgccggacgcgccgctgctgcacgccgacgacctggcggcggtgcgcggcgacggtgtcttcgagacgctgttggtgcgcgacggccgggcctgcctgatcgaatcgcacctgcagcggctgacccagtcggccgcgctgaccgagctgccggagccggatctgccgcgctggcggagcgcgatcgaggcggccacccggcggtggtgtgcgggcggcgccgacgaaggcgcgatgcggttgatctacagccgcggccgggagggcggttcggcgccgacggcctacgtgatggtcaccgccatccccgaccgcgtcaccgcggtccggcgcgacgggttggcggcgatcaccctcgatcgcgggctgcccgccaccggtgtcgacgcaatgccgtggctgctggccggcgccaagacgctgtcgtacgcgatcaacatggcggccctgcgtcacgccgcccgccacgacgccggcgacgtcgtcttcgtcagcaccgacggctacgtcctggaaggcccgcgctcgaccgtggtgatcgccaccgactccgaggcgcccggcggcggcccgtgcctgctgacgccgccgccgtggtatccgatcctgcgcggcaccacccagcaggcgctgttcgaggtggcccgggccaagggctacgactgcgactaccgggcgctgcgggtcgcggatttgtttgccgcccaaggtgtttggctgatctccagcatgacgttggccgcaagggtgcacaccctcgacggccgcccgctgccgcgcgcgccgatggcggccgagttcgccgagttggtcgacgccgccatcgtcagcgatcgctgagcgctgaattctgttgtcggctcgccgatccgcgggtacggtcggccgtacacaaggaaggaggtggtccgcgaaattgatagcttcatggacatgtgaggtggctgggcgctagctgcgccggctttcgaagagccggcgttatttgtgcgctggcgaattccccgtagtcacccggcccccgagcttcgggttgttgtccgaccaggaacacggctcgggggccgctccatgttcggggcggatgtgcctggcccagacaggccggccgctacccggcgaaccgggacagccgcgccgacagatgcggcaccagcccgccgtcggcatccacccgttcctcgacgtaggccagatctccgccttcgacgatgccgtagagccgtttggcgccgcccaccagcacaccggatcggctgcgggccagcgcatcggtcaccagctcccacgacgactgggtgcgcgggcgcccgtagaacagttcgacgtagcccgccgaatgcgccagcagcagttcgatcgcctgggattcgctgggatcgtcgggatcgcggacaaaccgccagaaaccggtctcgcgcaggccgcgctcctggtagtcacccgtgtcgttcagccgccaggacctggcctcccagttcaggtagtcgccgccgtcgtgggagaccacgatctgctgcccgaaccggtagtcgccgtcatggccccgcccctcgccctcgccgcgccacaccccgaccagcggcagcagcgccagcagcgcgtcgctgaggttggcgccctcgcgcaggttcgcggtgtccgcgggcaggggcaggtcgtcgaaggacgggatgttacgcccggcggtcagcttggcgcgctccgcggcggcggccaccgcccggtcgccggagcccgccggccccgacggatcgtcgccggcgggagtcacgactcgtcggtgatgagccggtacagcgtgtagagcgcaaaccaggaaatcaccacgaccgccacgaccagcatgatctcgaagaacaacaccacggggacaagtctattcgtcccccgctgtcccgatcgggtcagccggtgcgtcaggcgatcttgacgtcgacctcgtggatgcccgcacccgacggggtgaccacggcgttgccgttaccggccgccgagagtgcgcgcagcgtccaggatcccggagcggcgaagaagcggaaatcgccggtggccgacgccaccacctcggcggtgaactcgtcggacgagtccagcaggcgcacgaacgcgccgcccaccgcctggccgtcgctgtccaccacgcggccggtgatcaccgtttccttctccaggtcgacgctggcgggcagcgtcactccttgcttcggtgcagagcacatatcagcttcccaactcgatcggggcacccaccagggagccgtattccgtccaactgccgttgtagttcttcacattccgatgcccgagcaattcataaagaacgaaccaggtgtgcgacgaccgctcgccgatccggcagtaggcgatcgtctccttgccggtgtccaggccggccgcggcgtacagcgcggccagttcctcgtcggacttgaaggtgccgtcctcgttggcggccttgctccacggcacgttgatggcgccggggatgtggccgggccgctggctttgttcctgcggcaggtgcgccggcgcgaggatcttgccggagaactcgtccggggagcgcacgtcgaccaggttcttgacgttgatcgcggcgatcacctcgtcccggaacgcccggatgctgttgtccggtgcggccgcggtgtaggaggtcgccggcctgctgacggggtcgctggacagggtgcggccgtccagctcccacttcttgcggccgccgtcgagcagcttgaccttctcgtggccgtacagcttgaagtaccagtacgcgtaggcggcgaaccagttgttgttgccgccgtagaggatcacggtgtcgtcgttggcgatgccccgctccgagagcagcttggagaactgctgcgcgtcgacgaagtcgcgtttgaccgggtcctgcagatcggagcgccagtccagcttgatggcgccggggatgtgcccggcgtgataagcgctggtgtcctcgtcgacttcgacgaagacgacgcccggggtgtcgagattgctctcggcccagtcggtggagacccggacgtcggagcgtgccatggagtggatcctttcgatcgctttggttacggcgggtcaggtggagcgcgccgggcgccggaagcgggccaccagcgggtagagctggcagcccaggcagatgccgaaggcggcgttgaggaacgcggcggccagggcggcggcggtggcgacgaggccgaacagcgaagcacccgcggcgaatccggcggcgccgagcaccgcgaagatcaggccgacgagttgggcgaacttcaacggcgggatgggctcgcgctcccgcaccgggcccagccgcggcgcgacgacggcggcgaatacccgcccgtaggggtgcttgcgcggtccgccgaccgctccgatcgcgaagacgacggcctggacggccaggatcaccgccgcggcggccggactgaccgccgacacggccagggccagcaccagcactgcggtggtgacccaagcggcgaatcgcggtccacgcacgtcgaccaggtcgggctgcgtggtggtgttgctgctcggcaaggtactactcctcgatgccctgttgctcacggaaacgatgatgggagagacgccacggtcgggatccggggccgctccgagtgctacgcgaaagcgcggccactcagcagcaacagcaacaacaacagcccgcggtgcggcgcaggtcgactgcgcggcgcttggtgagcatgggctcgaggcgggctaacacgtcggtcagcttacctaatgacaccgtggtcaggccaacagcggtttcagggcggagcgcaggtcggcggcgccgggcactccggagctgcggtagcgctgccggccgtcggcgtcgaagatcagcgtggtgggcagcgacagcaccgcatagcggcgggcggtgtccgggtgggcgtccaggtcgatctcgacgtgcgccacgccgcccaggtcggcgcagacctggtcgaccacccggcgcacccgatcgcacggcccgcaccagggcgcgctgaagtgcacgacggtcggtccgtcgcgggacagccccagcgcggcgacgtcgtcgccggtgtcgcgctgcggccccgcgtcgatttcccggatgcgtctggagcgacgggtcaacagccagccggccagggttgccgcggcaagcaccgcgaagatcacgacgagggtggtcatgactgtttgaactcttcgagggtcacggttactccgtacgtgatgccctcgatgatcacgtcggagccgcgggccccctcggtggtgggcgcgacgccgaagggcagccgctgattgggcagcctgccgctgaaggcgtgcagcaccgcgtcgtgcttgtcggccggcacgctctggtcggcggtgtccgatccggtcaggacaccggtcggggtgaacaccagggtcgcggggtcgtcgggggcgatggacaggtcgaccgagacgctcacccggtggtcgaagccggccgatttgggggtgccggtgaacaccagcccgtgactgccggagatgcccgaggcggtgatgcccccggtggcggtgttggtctccttgggcggcgcctctaccatcaggtcgctgatgttcagataccggcccaggtgggtggagtcgatgatgatgcggctctccagcttgcgcaccgcgagcttggcgtcgggtgcgatcagccaggacgcctgcgccaggtccaccgagtacatggtggcttccagggtggccttgccggtcatcgcatggctgacggcgttggccttgatctccagctggttgtagttgccgcgcagggcctgcggaaggaacggaaacgcgacgatcgccacgaacgggtcggtgcccaggtcggcggccctgcgcacgctggacgacagccggtattccgcatagatgctggtcccgtagtcgacgccgatcgcgccgagggcgaccacggccaccaggatcgccgtcgcggccacaccgatcagcaccttgcgcacccgcatattgtggcgtaatccccgggagacggtcgccggcggaccgccggtggcagggctcacaccggctcatgtgccacgcgaaaaaaccaggtgacacgttatcgttagatgacctggtcatgatggcgttgagaattgggagatgccgttcccccgaactggagggactagttggagctactactgctgaccccggagctgcatcccgatccggtcctgccgtcgttgtcgctgctggcgcacaccgtgcgaaccgcgccgcccgaaccttcctcgctgctcgaggccggaacggccgacgccgtcatcgtcgacgcgcgcaccgatttgtcgtcggcgcgcgggctgtgccggctgctgagcacggccggccggtcggttccggtgttggcggtggtcagcgagggcgggctggtggccgtcaactcggactggggtctggacgagatcctgctgcccaccaccgggcccgccgaggtcgatgcgcggctgcggctggtggtcgggcgccggggcgggctggcggaccaggaaagcgccggcaaggtcaccctgggcgagttggtgatcgacgagggcacctataccgcccggttgcgcggccgcccgcttgacctcacctacaaggaattcgagttgctcaaatacctggcccagcacgccggccgggtgttcacccgcgctcagctgctgcacgaggtgtggggatacgacttcttcggcggcacccgcaccgtcgacgtgcacgtgcgccggctgcgggccaagctggggcccgagtacgaggcgctgatcggcaccgtgcgcaacgtcggctacaaggccgtgcgcccggcccgcggccgtccgccggtggccgaggccgacgacgccgagtccgagtccgactccgcgtccgaatccgacgccgaggacgtccacgatccgctggtcgatccgttgcacactcagtgaccgcggctgactggcgccgcacgctgaatccgcaggagcagcgcgaggtgcgcgaactcgtcggtgcggcaaccgaattcgatgcggtggcgcccgtcggcgagcaggtgctgcgcgagctcgggcacgaccgcaccgagcacctgctgattcgcggatcggtgtccggcggcgccgccgacgccgtcgtcggctacctcaatctcaccccgccccgcgacgcgcagccccagatggccgaactcgtggtgcacccgcgggcccgtcggcgcggcatcggatccgccttggcgcgcgcggcgttggcgaaaaccggtgcggccaaccggttttgggcgcacggcacgctcgagccggcccgggcgaccgcggcggcgctgggcctgtcgccggtgcgggaactgatgcagatgcgacgctcgctgcgcgacctccccgacagcgtgcccgcggtgcccggggtgcgcatccgcacctacgcgggcccggccgacgacgccgagctgctgcgggtcaacaacgccgcgttcgcctaccaccccgagcagggcggctggaccgacgtcgagctggccgagcggcgcgcggaaccgtggttcgacccggcgggcctgttcctcgcgttcggcgacgacgacagcgatcggccgggccggctgctgggcttccactggaccaaggtgcacctcgaccagcccggcctgggggaggtgtacgtcgtcggcgtcgacccctgcgcgcagggccgcgggctcgggcaggcgctgacggccgtcgggatcgaatggctggcgcggcggctgggtgccggcgactccgcggccgaccccaccgtgatgctctacgtggaggcggacaacgtcgccgcggtgcgcacctaccagcgcttgggcttcaccacctacagcgtcgacaccgcatacgcggtcccaccggcggccaactgaccgcgggtacgaaccccggccgcccagatcgttaatctggtccttactacccagacgttgctgtgcgccgcgtcggcgcatattttcgccgcgagttggcaacctgacagtcatgcccgcggcgcccgcacgcgtcggtgaacgtgtcaagaaagcgagatcgtgaggctggacaggcagggcggggcgctggccgccgcggcgctgaccggctgcgggagcgacgagaaccaccgcgggaccgccgcgccgagcatcagcggaaccaccggcaccgcgggctgcggcggcaagaacaagctgaccgcggagggctcgaccgcgcaggaaaacgcgatcacgatgttcaaccaggtgtggggccagtactgcccgggcaagggcctggcctacaacccgaccgggtcgggcgccggccgcgagcagttcatcgccgggcacgtggatttcgcgggcgcggactcgccgttggtcgccgaccagatcggcccggccgcccagcgctgcggcggcaacccggcctgggacctgccgctggtgttcgggccgatcgcgatcacctacaacctgcccggcaacccggccctggtggtcagcagtgacgcggtggccaagatcttcaccggcaagatcaccaactggaacgacccgatcctggcggccctcaatcccggggtggcccttcccgacaccaagatcaccccgatctaccggaccgactcgtcgggaaccaccgataacgtgcagaagtatctgaccgccgccgcgccgcagagctgggccaagggcgtcggcaccgaattccagggcggcgtcggcgagggcgccgcgaagtcggcgggagtcatccaggcggtgcgggccaccaccggggccgtcggctacgtggagaagggcttcgccgaccaggccggcatgccctacgccaagatcgccacccgcggtggggtggtcccgctgaccaacgagaccgccggaaacgccgtcaacgcggccaaattcctgtccgagggcgacgacctggtgctcgacctccacgccatgtacgcctcccaggagccgggcgtctacccgttgctgctggtgacgtacgagatcgtgtgttcgaaggggtacgaccccgagacgctggcggccgtgaaatcgtttctcggcgtggccgccaccagcgggcagaacggcctttccaccgccggctacatcccgctgcccgataaggtcaggcaacgactggtgaccgcgatcaatgcgttgcagtagccggcgggccggggtttcagggagcgacggcaggactgtggtgggcgcaccgtgacggggttttccgggccgaatcccaccgacgcgggctcgggcgcggtggtcgccgcgccgttcccggagccgtcggcgacccccatcagcccctgggggcaggggcgaccgcatgcgggggaccggattttccgccggctggcgcaggcctccggggtgctgatcgtgctggtgatcgccgcgatcgcggtgtttttgctcgaccgcgcggtgccggcgctgcagcgcaaccgcgagaacttcttcggctacggcggtaactgggtcaccaccgacacctcggcgatgcatttcgggatcgccagcctgctgccggtcaccgtgttcgtgtcgctgttcgcgttgatcctggcgatgccggtcgcgctgggcgtcgccatcttcatcacccactatgcgccgcgccgcgccgccaccccgctggcctacgccgtcgacctgctggccgcggtgccctcgatcatctacggcgcctggggcctgtacgtgttggcgccgcagcttcgacccgtcgccacttggctcaaccactcgatgggctggtgtttcctgttcgccgacggcaacacctcggcggccggcggcggcaccatcttcaccggcggaatcgtgctcgcggtgatgatcctgccgatcatcaccgccgtcacccgcgaagtgttcatccagaccccgcacgaccagatcgaggccgcgctggcgctgggggcgacccgctgggaagtggtccgcacggtcacgctgccgttcggccggtcgggctacatcagcggcgggatgctggggctgggccgcgccctgggtgagacggtcgcgctgctgatcatcctgcggggcacccagtcggcgttcggctggtcgctgttcgacggcggctccaccttcgccaccaagatcgcgggcgccgcggcggaattggacgaccgcttcaaagccggcgcctacatcgcggcggggctgacgctgttcgtgctcaccttcgtggtcgacgccctggcgcgcggcgccgtcgccggggtgggcaggcgggcgggcccatgacctcgatgctggaccgcccgctcaagtcgcggacgttctcgccgctgtcccgacgccgtcgagccgcgaattccgttgcgaccgtgctggtttcgttgtcgttgctggtcgcggtgaccccgctggtgatggtgctgtgctcggtggtcgtcaaggggttcagggcgatcacctcgaccgtgtggtggtcgcactcgcaggccgggatgaccgcgttcgtgaccgggggcggtgcctatcacgcgctggtcggcaccgtgctgcagggattggtgtgcgcggcgatctccatcccgatcggcctgatggtggccatctatctggtcgagtacggcggcggcaccccgctcggccggctggcctcgttcatggtggacatcctgagcggggtgccttcgatcgtggcggcgttgttcgtctatgcgctgtgcgtggccacgctggggctgccgcgctcggagttcgcggtgtcgctggcgctggtcctgctgatgctgccggtgatcgtgcgggccaccgaggagatgctgcggatcgtcccggtggatctgcgcgaggccagctacgcgctgggcatcaccaagtggaagaccatcgcccgggtggtcctgcccaccgggctgtccggcatcgtcaccggcatcttgctggcgatggcccgggtgatgggggagacggcgccgctgctgatcctggtcggctatgcacagtcgatgaacttcgacatcttcagcgggttcatggggacgctgcccggcatgatgtacaaccaggcgtcggccggcgcgggcatcaaccccatccccacggatcggttgtggggtgccgcgttgaccctcatcctggtgatcgccacgatcaatgtcgtggcccgggtaataaccaagttccttggcgccagaaagtcataggcaggagcacgagtggccaaacggttggacctcaagggtgtcaacatctactacgggtcgtttcacgccgtcgcggaggtgacgctgtcggtgcttccgcgcagcgtcacggcgttcatcggcccgtcgggttgcggcaagacgacggtgttgcgcaccctcaaccggatgcacgaggtggtgcccggcgggcgggtcgagggaagcttgctgctcgacgacgaagacatctacggccccggtgtcgaccctgtcggggtgcgccgggccatcggcatggtgttccagcggccgaacccgttccccgccatgtcaattcgcgacaacgtggtcgcgggcctgaagctgcaaggggtccgcaaccgcaaggtgctcgacgagacggccgagtactcgctgcgcggcgccaacctgtgggacgaggtcaaggaccggctggacaggcccggcggcggactctcgggcgggcagcagcagcggttgtgcatcgcgcgggccatcgcggtgcaaccggatgtgctgctgatggacgagccgtgctcggcgctggacccgatttcgacgatggccatcgaagagctgatcagcgagctgaagcaggactacaccatcgtcatcgtcacccacaacatgcagcaggccgcccgggtcagcgactacaccgcgtttttcaacctggaagccgtcggaaagccgggacgactgatcgaggtcgacgacaccgagaagatcttctccaaccccagccagaaggcgacggaggactacatctcgggccgcttcggttaactaactgagcccggcgacgaagcagctcgcgtagcgaggtgtgaggagtcgggaaatcggacccagcccggcgacgaagcagctcgcgtagcgaggtgtgaggagtcgggcaatcggacccagcccgattcgcttactgcgaggcgggtttcgtctcttcctcgggcagtctgccggtggcctggaagatgacccgcctggccacctcgacggcgtggtcggcgaagcgttcgtagaaccggcccagcagcgtcacgtcgacggccgccgcgacgccgtgcttccattcacggtccatcagcaccgagaacagatgccggtgcagatcgtccatcgcgtcgtcctcttcgcggatccgggccgccttctccgggtcgcgggacaacaccacctcttgggcgctgttgcccaattcgactgcgatgcttcccatttcggcgaaataaccgttcacctcttcgggcagcgcgtgctgggggtggcgtcgacgggcgatcttggcgacgtgcagcgccagcgcgcccatccggtcgatgtccgccaccatctggatggcgctcacgatggcccgcagatcgccggccaccggcgcctgtaatgccaacagtacgaaggcggtttcctcggcgcgcgcgctcatcgcggcgatcgcttcgtggtcgctgatcacttgttcggccagcaccaggtcggcctgcagcagcgcctgggtggcccgctccatggcgacccccgccaagccgcacatctcgccgagccgctcggacaactccgagagctgctcgtggtaggcggttcgcatgtggtccagcgtacgttctttgcacccgaaacagtcggcggaacgccgtcaaaaccggttactcgcaggtggtgtcggccgcgttggtgaccgtcaggtcctcgggcagcttggccggcgcgttgctcgagccccgttcgatctgcaggctcatcgtcgagccgctgggtgagggagcggtgaccgacttgaaatcggggcccagcaccacctgcacgacctgtccgtagccggacacccgctgcaccttcgcgttggcgaacgaggacgccaccgtcgccgccgcctcctcgttgcccggtgagaacagcaccgtcgtcgtgttcaccgaactcggatagtcatcgggggtcatcacgttgaagccgtcgcgcttgagctggctggtcgccgtggccgccagtccgctctgcgtggtcgcgttggaaacacgcaccgtcacaccgctcggcgaggtcgtggtgacctgctcgcgctgcggctccggcgtcggggtgggcgacttgcgggtggtgggcgccttcggcgcgccggtggtcgaaccggaagcgctcaaattctgtgcgttctggtcgttttcctcgggcagcgggtcgtcgttgatgatggcgtcgaacagcgcgcgcatgtccgacatccggggcggctcgtcgccgttctggtcggtgacgccggtcggcaccgtcacgaaggtgacgtggccggccgccatgccctgcaacgactggccgagctggacgaggtccttggacttcacgttgtcgacgacggtgtcgttgatcacgaggttgacgacgttgttgagcttgttgaggtcgagcagggtgtccgcggagatcagtgaccgcagcagcgaggacaggaacaactgctggcgtttgatgcggccgtagtcgccgttgacctcggtggtgacctggcgggcccgcacgtagttcagggccgtgtcgccgtcgaggacctggcgaccgccgtgctcgagcaccgtgcccagctcgtagtcgtgcagcggggtgctcgagcacacctcgacaccacccagggcgtcgaccatcttcgcgaacccggcgaagtcgacggcgatgaagtggttgatgctcagaccggagagcttctggatttccttcaccagacacttggggccgccgaacgcgaacgccgagttcaatttggtctcggtgtagaccatcttcgggccccagctcttggtcttcgggtcatagatgggcccgtacttgccggtgctggggtcccacgcctcgcactgcatcggggtgatcgccaggtcgcgggggaacgacaccgccaccacgcgtttgcggttggccgggatgttgaccagcatcacggtgtccgagcgggcgccgtcggcgtcgtcggtgctgccggcgcccatgttggcgttgtcgccggcgcgcgagtccaggccgacgatcagaaagtcttcgtcgccgtactgtccgcccgggtcccggatgtcgctggaattgcggtcgagcgcgttgatcgtgttgagccgggcgtttttcgacgcgctccactgccacgccccgccggtcgtcgccagggcgagcacggcggccagggccgccaccgaccgcccggccatcagcatcggacggcgccggcgccggggttccccggcggcggtatcggcggcgtcggcgctctgctggtcggagtccccgtcgttcgggtagtcggtggccatcagctcgcgaagctcggagaccgcgtccaccgagtaggccaggtcgtcgatcacctgggtctgctgcagctcgagcggcagccccgacgcgggcccaggcggctcggatccgacgggctcgggttcgacaggctcgggttcgatcggctcggtctcctccggagccgcgcgacggtgcacgggccggttcggggcgccgaccttggcgatcagatcggcgacggtgacgccgccgccggtgtggcatccgcccggctcgtcgtcgtcctcgggtgcggcgacgggctcgagggcggcggcgtccggccgccaccggtgcaggcggtcgtcgggcgggggttcgaagaagcgctcccagggagcggcggccaagctgggcgacgggccgaccgggatcggttgaacgcgagccgcgcccggtccgtgccgaccgttacgagtgccgtcgctctcggcgtcactcatgtcctaccggcctccgaagctctgatgcagacgtcagcgtgttggtgcgtgccctcagcgcggcaccgcatccccggtgccgccgctggtgccaccctcttcgtcgcgttcgcccggtgcgtgccaacctcatccgccacccatgcgcatgcaacaaagcccacatcgtactgagttctcggtccggacgcgattccgcgcggtgactcagccgccggagtgcatgatgtcggcgccggccggcaccgtgcagtcgtccgggtcgtcgagccagccctccggcagcaccacccgggcgggtgaaccctgccgcccccggggcccggtcgcctcgtccgggaacggcaccgagccgtccaaccggtcgagcaggcggtccagctcgtcgagcgtcttgaccatcgccagcgcgcgccgcagctcggaaccggccgggaagccgtgcaggtaccaggcgatgtgcttgcggatgtcgcgcatgcccttgtcctcgccgaagtgggcggccagcagccgcccgtgccggcgcacgatgtcggccacctgccccagggtgggcggcgtgggcggcgggctgccggtgaacgcggccgacagctcggcgaacagccacggccggcccagacagccgcggccgatgaccacgccgtcgcacccggtggcggccatcatggtcagcgcgtcgctggcgtcgtagatgtcgccgttgcccagcaccggaatggtgcgcacctgctgcttgagcagggcgatctgttcccagtccgcggtgccggaataccgctgcgccgcggtgcgggcgtgcagcgcgaccgccgcggcaccctcggcctcggcgatgcgcccggcatccagatgcgtgtggtgctcgtcgtcgataccgatgcggaacttgacggtcaccggtatctcggtgccctgcgtggcgcgcaccgccgcggcgacgatctgcccgaacaggcgtcgtttgtagggcagcgccgagccgccgccgcgcttggtgaccttgggcaccgggcagccgaagttcatgtcgatgtgatcggcgaggccctcgtcggcgatcatcttggccgccgcgtaggtggtggccgggtcgacagtgtagagctgcagcgaccgcggcgactcgtcgggggcgaacgtgatcatgtgcatggtggccgggtgccgctcgacgagcgcgcgtgccgtcaccatttcgtagacgtagagtccgctgaccgtcccgaccagctcccgctccagctcacggcacagggtgcgaaacgcgacgttggtgaccccggccatgggagccagcaccaccgggctggccagctcgatggggccgatacgcaacgctggttaccgccggctcatggtcagcgtgcccgcggtggtgtgcagctccagcgcggtggtccgcttgccggtgcgggcttcccgctcgagctggcgccgcttggagatctcgaacttgtcgcaggtcgtctcgagctccttgatcagcagcgccaggtcgtcgcgcagcgcggcggcctcgccggtgaagtcctcgcgctcgaagatgcgccacttcttgagcaccggcatgacgacgtcgtcgaggtggatgcgcgggtcgtagacgccgccgacggcgatcatcacggccttgcgccggaactcgggcacctggtagccgggcatctggaagttgcgcagcaccttgtgcagcgatttcatcgcctggttgggcgcgatcgcgaagccggcctcgctgacgtcgcggtagaagatcatgtgcaggttctcgtcggccgagatctttgccagcatctggtcggcgatcgtctcgttgcaggccttgccggtgttgcggtgcgagatccgggtggccagttcctggaaggtgacgtagatgaccgagtcgaacaggctctcggcgaacaggtcctcgcgcacctggtggttctggcccgggctgaagccacggttgaccacctcgatgcgcagcttctccagctcgaccgggtcgaccgcgcgggtgaccaccaggtagtcgcgcagcgcgatcccgtgccggttctcctcggcggtccagcggttgacccactgcccccacgggccgtccatgccgaagttcatcgcgatctcgcggtggtacgacggcaggttgtcctcggtcatcaggttctgcaccatcgccacctgggcgacgtcggaaagcttggactggccgggttcccagtcctgcccaccgagcgcgtagaagttcttgccgtccgaccacgggatatagtcgtgcgggttccagttcttgtgcatgctctcgtgccggttcaggtatttctcgacgaacggctcgagctcctgcagcagctgtaggtttgtcagctcggctgacataaggcctccagttatctgtgtcgatgggtagcactcaatatatctgtgtacctcagtagcatcaagttcctcgtccggcgcggcaaacggcgattttggtgccggtttccgggcccgtccggcctcttgcggccgtgccgggcccggcgatacgggcttgccgatccggccgagatgcaaacccgctactgcggtttgccgagctcgccggccgacacgtacggggcggcggtgatgtagagcatgttggtgcagtagtcgatgaactgcttgcgggtggctccgagctgaccgtgcaggtaggcggtgaacaggctggacagcccgcccaccaggctggtggcgatcatcttctgcagcaccgcgtcgccgatccgggacagcttgcgctgcagcaggtcgatgaagttgggcatccactccgcgccggagcgggtcagcaccggttccaccgccggcgccagcaacaacacccggccgcgcaccgggtcgtccaccatcagctcgacgaaccgttcgaccgcctcccgcggggtggtcgccgacgtcagggtgttcatcgcgcgggtgcacacgtcgtcgtagaccgcgcgcacgaactcgtcacggtcggtgaagctttcgtagaagtagcgctcggtcagcgcggccttgcggcacaccgcgcgcacggtcagcgccgggccgccggaaccgccgagcaactgcaccccggcgttgatgaggttgtcgcggcgaagcgcgaggcgactctccagaggcacgccggtccagcggccccgtcgttgacccgtctgcacatcgctcctaagctgaaaacttgacaacggttgtagtcaaaaattcacatacccacaggaatccaatagtgactcaagatacgtccgcatcgcgccccctgaccagcgacgtaacgggcagcgatgcggccggtctcactgagcagtcgatttcggcccggccggccgatgccggcgccgcggttgccggcggctgcccggtttcgccgctgggctatgaggccccgcccgcgccgctcggccccgactcgctgacctggaagtacttcggggactggcggggcatgctgcagggcccgtgggccggttcgatgcagaacatgcacccgcaattgggcgcggccgtgctggaccattccaccttcttccgcgagcgctggccgcggctgctgcgctcgttgtatcccatcggcggcgtcgtgttcgacggcgaccgcgccccgatcaccggcgccgaggtgcgcgactaccacaccgacatcaagggcgtcgacgagcagggccggcgttatcacgcgttgaaccccgacgtcttctactgggcgcactccaccttcttcgtcggcaccatccatgtggccgaacggttctgcggcggcatcaccgaggagcagaagcggcagctgttcgacgaacacgtgcagtggtaccggatgtacggcatgagcatgcgcccggtgcccaagtcgtgggaggagttccaggagtactgggatcacatgtgccgcaacgtgttggagaacaacgaggcggcccgggccgtgctggatctgaccgagttgcccaaaccgccgttcgcgcaatggattccgaaccgcctgtgggccgcgcagcgcaaactgttggcgccgttcttcgtctgggtgacggtcggcctgtacgacccgccggtgcgggagctgatgggctaccggtggtcggcccgcgacgagtggttgcaccggcgcttcggcgacctggttcgtatcgtgttcgccttggtgcccagcagattccgcaagcacccgcgggcccgcgccggactggaccgcgccagcggccggatcccgctcgacgccccgctggtgcagactccggcgcgcaatctgccgcccgaggacgaacgcggaaatcccaagcactactgcccgatggtgtcgtagccgggcgccgacgggcttaggcgtgggcgtgctggtgcacgtcctcgaggcccgcctgatgcacgtgccgatgggtgtgttcggtgccgtcggtgtgtgttcggtgccgtcggtgtgcgcgtgggcgtgctcgtgctcgacgtggtcgtgctcgtgcgtggtgtgcgcgtgcgcgtgcgtcacgccgccgtgctgatgttcgtgcgtgtgcggcgcgtcgtgggtgtgctgttcgctcatcatgttctccgttgcgtgaaataccttgcgtgatacgttgtgccgccggctgactcagcgcgcggcgccgcgcggccggtggcgtgacgatgcggccaccgacttgagcccgccctcgccgcggtggtgacccggcaccccgggaccggcgtgctcggcgttgaacaccgcgtcgatcaccagctggcgaacatgttcgttctccaggctgtaaaagatcgtcgtgccctcccggcgggtgcggaccagacgggccatccgcagcttggccaggtgttgggacaccgacggtgccggcttgcccacgtgctcggcgagttcgttgaccgacatctcgcggtcggtcaacgaccagagcacctgcacgcgagtggcatcggccagcatccggaagacctcgacgaccagacgtacctggtcgtcgggcagccgacctgcactactatctgcatgcatacgcaaatactagcgaaggtcggccggtctgccaaggcgcggctcagtccgacggcaccaccgtcgaccggcgccggccgccgttgcgctcgttccacagccggtagacgtccacggcgtccgggtgcggctggtagcgcatcggaagccggcgctcgtcgaacggcttggcgaattcggcgtagaaattcgacaattcgaagtacttgcggtcgtccacgtaatacggctcgtagctttcccgggtggtcagaaaaatgacttctctgggcgagcagtagtacagcgcgcccaggcacatcgggcacggatgcgccagcacatagatggtggcgtcgacgagatgctcggtgcccagcttcaggcaggccgcacggatggccaggatctccgcgtgggcggtggggtcgttggtctgggccgccttgttggcgctctcggcgaggacctcgccgtcctggacgatcaccgtggcgaacgggcggccgccttcggccacgttttggcgggccaggtcgatggtccgccgggcgaaatcggtcacgaattgcagggtagtccgcgcggcctcgtgcaatcggccctgttttactgactagatcgtctattcaaatccgggatgaggaacaccatggcgcgcaccgaccgtgatcgttgggacctggcgaccagcgtcggggcgaccgcgaccatggtggcggcccagcgggcgctgtcctcggatgcgaacttgatcgacgacccctacgccgcgccgctggtgcgggcggtcggcatcgacgtctacgtccggttggtggacggggagatccagcccgggacgtccgagttcgacccgcatcgcatggcgaaggggatggcttgccggacaaggttttacgacgacttcttccttgacgccgcccgcgccggcgtcggccaggcggtgatcctggcctcgggactggacgcgcgcgcctaccgcctgccctggccggccggcaccgtcgtctacgaggtcgacatgcccgacgtgatcgagttcaagaccctgacgctggccgacctcggcgcgcagccgaccgcgcagcggcgcacggtcgcgatcgacctgcgcgacgactgggccgccgcgttacgggaagagaggttcgacacgcaggctcccgccgcgtggagcgccgagggcctgctggtgtatctgccggagcaggcccaggacgcgctgttcgacaacatcaccgcgttgagcgccccgggcagccggctggctttcgacttcgtgcccgacaccgccgttttcgccgacccgcgctggcgcgcccaccacgaccggatgagcgagctcgggttcgaggtcgatttcaatgacctggtctaccacggcgagcgcagccacatcgtcgaccacctgagcgggcggggctgctctctggtgcccctgttcagggtcggttgatcggtgacatttctatgtcggttgatcggtgacactctgggttgtgttttaggccggtgcgttggtgcgcagggcctgtttgtttcgtacctcgccgcggctggtgcgcgcggcggttttgaccagattgtcgccgacccaaaacctcagcaggtccccatcgacgtggacatcgcagcgggcgccggcatagtggcgcccgatacagacctgctgccaggacacgcacacgatgccgttggagcacacccgccgactcacccagtcatcaccactgcggtcgacgtgtcgggcacacgagttcgacggtggtgatgccggcgcaccggcgtgaaaccgttgagccggtgtgatcatctttagggcttggtgcggccgggtggtgttgtagtcctcgacccactcatcgagcgcctgctgagcgaccttgaggttggtgaaaggctcacggccgctaaggaactcagcgcgcagactgcggtgaaactgctcgattttgccggtcgtggtcgggctgcgcggctgggtcaacagatgttcgatgccgtgctcgcggcagatcgcatcaaagagcacctcgaccggtggatgacaaaaccgctcggtgaacaccttgccgttatcggtcaagatctgctcaggcaccccgtaagcggccagcgccgcccgtaatccgtcgcagaccgcgcgggtgcgctcacgggccatcagcttggcgcacacacacatccgggaatgatcatcgatgccggtcagggctttggcgctggtgccatcggccagcgggaacccgccgacgatgtcgagctgccacaactccatcggcgccccgcgctcccagcgcttccatttgcgcgaccgtcgatctcgcatcgcggggtcgatcagaccggcccgcaccagcgctcgatacaccgccgactccgacggcaccggatggacacctcgcttggccaactcgaacaccaaccgccgcggcccccaatagggccgcgagcggcgcaactccaacaccgccgcctccactaccgccagcatctgatgcggacaactcaccggccgatgcgaccgatccaccagcccctccaggcccgcggcttcataccgggccagccatcggtgcagcgtctgacgcgccaccccgaacttctctgcggcctgcgacaccgacaacccgtcactgattaccgccatcacggcctgataccgctgctcagccacacttaactccctcatctagggagtgtcaccgatcagccgaaacaactgtcacgcatcaaccgaaacaccgtcacacatcaaccgaagacaaaacgtcacacatcagccgacgtcatacatacatctggtgcccccactaggactcgaacctaggacctgcggattaaaagtccgtagctctaccaactgagctataggggccgcggagtttcaggatacttggacccaaaaccgggctcgtttgaggattgggcccacggtgacctaagctgacgtggctcccaacgaaaccacgttgcgagtaccccggagagattcggttctggcccccttcgtctagcggcctaggacgccgccctttcaaggcggtagcgcgggttcgaatcccgtagggggtacgcaacgcggcgacgcggagcagcagcaaggccctgtggcgcagttggttagcgcgccgccctgtcacggcggaggtcgcgggttcgagtcccgtcagggtcgccagcgcggcgaggcactcgctgccttccggccaggtagctcagtcggtacgagcgtccgcctgaaaagcggaaggtcggcggttcgatcccgcccctggccaccgggatgatcctcaccgccggtgagcgagatgccggcgcggctacttgagcatgctgccggcgtcgacggtgaccggaagacctgtgatgtaacgcgattcgtcggaggccaggaacagcacggcgttgctgatgtccaccggctccacccagccgaccggcagcacatgcatgaactgcgcggcgaccttcaggtcgtccgggccggggttcttcaggtccggccggaacagcctcatcgtcccctcgttcatgaacatcggtgtgttcacgttggtggggtgcacggaattcacccggatgaagtgctggccgagctcgacggcgaacgtccgcatcaacccgacgacaccgtgtttggcggcgatgtagtggccggtgtgcgggtaggccttgagtccgccgaccgagctggtcaagatgatcgatccgccgtgcccttgcgaaatcatatgcggcacaccggctttgacggtcttccagacaccggaaaggttgacgtcgatcatgtctcgccagtcgtcttcgctggttttgtccagggtctggccgccgttgccgattccggcgttggcgcagatgatgtccagccgtccgagctgttcgacgccgctgtccaccgccgctttcagcgcgtagtagtcacggacgtcgacctcggcggtcacgatgcgccggtcgaggcccttgatgaggtcggccgtctcggccaggtcgtccggcgtcgagggcgggatctggctgttgctgctgatcggggcgcagatgtcgacggcgatgatgtcggcgccctcctgcgccagccgtaccgcgtgactgcggccctggccccgcgccgccccggtgatgaatgcgaccttgccctcgactcttccgcccatgattgtcctcactgatttcagaggccgggatgacgatggcccggcgcgcacctgttggtcgacgagaaattatttgtcgatcgatcaggagggtggcaccgtttggccacagtgtcaacagatgccggtgctagccgctggtggtcgacgcggccgcgggtgcggtgagccgactcagctggcgttgcacgaatacgcgcaattcgtcgtgtccctgggtgacgccgacggccttctcgttgcacaggctgcgcgcggcctgcgcgatcagcatcgagatcgcgaccgggggatactcctcgaggtcgatgccgttggcgcgcagcaccatggtcgccgccgtggtctcgatgtcgcggacccgctccgcgtatgccttgagttcggcgccaattgccttgcggtggttggccaacgccatgaactcggcgttcagcgcggtcagcgccgtgtcgctgttcatcagccacagcgcttgcagcggatcgtcctcggtcagtagcgcccgcatccgggtcagcgcgctctcggcccccgcccgcagcacctccacgaaaaggtcgtccatggtcgggaagtagtaatagaccagcgcctgcttgacgcccgcctcggcggccacccgccgcgacgtcgccgcggcatagccttcttcgcgcatcagccgggcggtggcctcgatcaatttggtgcgcgctcccgcgtcggtattccgccgggagcgccgggtggccgcgcccgttttgcttgaccggcctgcgcggtccgtggtaggcataccgcatcctaacaatttggtcgatcgatcagtatcgcaggcggttcggagggtgaaaggggtcaagacatgcgcgttcgggtggatccgcggctgtgtgaggcccatgccctgtgcgtggagatcgccccggaggttttccggctggacgacgacacggcgagctgcgcggacgacccggccgaatcgttgcgccacagcgtgcaggcggcggtggcggcttgtccacgccaagccatcagcgtgctgaccgaacaaccgccgtacgcgcccgacgaaggaaattgagctcatgaccgatctcgcccaggtcgactacttcaccgacgccgacgtcgcccaggatccctatgactactgggattatctgcgcgagcaggggccggtgttccgtgagccgcattacggcgtggtggccgtcacgggctaccaggaagtccaggccgcgttcaaagacgtcgaatccttctccgcggtcaacgcgatcggcggcccgttcccgccgctgccgttcaccccggaaggtgacgacatcagcgaactgatcgaggcgcatcgccacgagttcccgatcttcgagcacatggtggtcatggacccacccgagcacgacaaggcgcggtcgctgctcggtcgcctgctcacaccgcgccgactgcaggaaaacaaggattacatctggcaattggccgaccggcagttcgacgagttcatcgccaacggtcactgcgagttcctcagcgagtacgccaagccgttcgcgacactggcgatcgccgacctgctgggggtgcccgacgaggaccggccacagatccgtcgcaatctgggcgccggtaacgcgccgggcgcccgggtgggcgcgctggatcacgaaccggtgggcagcaacccgctgcagtacctcgacgacctgttcagcggctacatcgccgaccggcgcgagcgtccccgcgacgacgtgctgaccggcctggcgaccgccacctatcccgacggctccaccccgccgttgttggaggtggtcagaccggccaccttcttgttcgccgccgggcaggagacggtgaccaagctgctcagcgccgccgtgcaggtgctcggcgaccagccggagctgcaggcgcggctacgcgccgaccgcggcctgatcggcccgttcatcgaagaagcgcttcggatgcaaagcccgaccaaggtcgacttccggctggcgcgcaagaccaccaccctgggcggggtgcacatcccggccggcacggtcatcatgctgtgtctcggggcggccaaccgcgacccgcgaaaattcgagaaccccaacgagtttcgtatcgaccggaagaatgtccgcgaacacatcgccttcggccgcgggatccacacctgcgccggcgcgccgctggcccgggtcgagggccagatcaccatcaaccggctgctggaccgcaccagcgagctcaggatcaataaggccaagcacgggccggcgtccagccgccaataccgctacgagtcgacgttcttgctgcgagggctgaccgagctgcacatcgagttcacccgggccggctgacggcgcctgcgaattcgcccggcagctgaacccggtcttcgcaaaccacgacaatttccttgtagtgcaacggatttagagacgatgcgcggtatccgccccttcgcgcgggagggcgggtagggtggtggcaacggcgaggaacggattccatggcaatacagaactggtgcgacgcggtcgagattcacccatcgcagatacgggtcggcgacatcatcggcacgcggcgtcccaccgaattgcggctgacggtccggatgatcagcggtccgcagagcggtccgggtcagtggacatttttcagtcgagacgacaacggtcagcagcgaaccagtaccttcggagaaggcgaattggtccgcaggtacgcccgggcgtcctgacgcccgggcgcttcaagccgatcagcgccgttgatttgtggatccgccggtgtcgggccgatcggaaaacatcgggtactcgacgggtttcgcggaggtttcccccgacgcgacatacttcggctcctcggggtgggaaaacaggttcgactggtccatggttgtccttccggatgaagagttcggccgatacgcatcgctgcttggcgtcggacgacgatcgaatcgcacggcggtctgattcgtggttcgtcggcgattcgcggtgaccgtaagaatgcggttccactccactctacaggcagcccgagccgcgcttggcgcgtcgggtgagacggagcccgggcgaggccgcagtccaggtgcacagcgaatgaatcggcaagtgaggcaactgttttcaatatatggtcggtctcatgctaccctgaacccgcacggatgtgattggtacatccgcatttgatgagagaagtaagtaaatggcacagggaactgtgaaatggttcaacggtgaaaagggcttcggcttcatcacccctgacgacggcacgaaggacctcttcgtccattactccgagatccagggaagcggctatcgctcgctcgacgagaaccagcgtgttcagttcgacgttgagcagggagccaagggaccccaggcggtaggagtcagcaccgtctgagaacgtcacaaacgtcacggtggggctggtgcgattgacttcgcaccagcctcactggtttttccgatcgctgaacggccggtggcgacaacacccggcggctgaccccggcgcggccgaccaaccgggataatgaccgcatgcgtctcgcgtgggtgctgcgactgacgattgcggcgtcgttggtcgcggcgggcgggacgcgtaccgccgaggccagcccggatgtcccgccggtcagcgacgccgcgaaagcggccggcttcgtggacatccgcagcgtcattcccgatgcggtgctcgacctgcgctatgcgacgtccaacaatttcacccatacgcagctgtatccctccgacgccagatgccttgtgcaccaatcgatggctcccggccttgccgcggccgccggtgcgctgcgcccacagggtcacctgctggtgttctgggactgctatcgcccgcatgacgtccaggtaaagatgttcagcctggtccccaaccccgcctgggtggcccgcccgggcgcgtatgcccgcagccacgagtcggggcgttcggtggacgtgaccttcacgacggcacagcagccttgctcgtccgggttgcacgccggcgggctgtgtctggccgacatgggcactgacttcgacgacttcacctcgagggcaacggctttcaacacgcagggcatcagtgccgacgcggtggcgaaccgggccgcgctgcgcaacgccatgaattacggcggattgaaggtgtactcgggggagtggtggcatttcgacggcccgggggccggtgtggaccaaccgatcctcaacgtccccgtcgactaggtgtctcatattccgagacgagagtttcattatatggggcaccgtcggtagcctggccgaacaaggacacgcgcgagccgaggggccacagtgaacgaccaacatcgagcgacgtatacgcacgggcaccacgagtcggtgctgcgcagtcaccggcggcgtaccgccgaggactccgcgggttacctgctggcgcacctgacaccgggcctgtcggtgctcgacgtcggttgcggtcccggcaccatcaccgccgacctggccgcgcgggtcgcgcccgggcaggtcaccgccgtcgaccaggcggcggacgtcctggatgtggcccgcgccgaagccgagcaacggaatctgtccaacgtctcgttcggcaccgccgacgtgcaccgtctcgacttcgccgatgacacgttcgatgtcgtccacgctcatcaggtgctccagcacctgtccgatccggtcgccgccctgcgcgagatgcggcgcgtgtgcaggccgggcggcatcgtggcggtgcgcgacgccgactacgcggggttcatctggtatcccgaactgccggcgctcgacctgtggcgagacctctaccgacgggtcgcgcgcgccaaccgcggcgaaccggacgccggccggcggctgctgtcctgggcgcggcgggcgggcttcgacgacatcacgcccaccggcagcctgtggtgctatgcgacacccgagacgcgcgactggtggggcggaatgtgggccgaccgcatcctgcattccaccgtggcccgcgacctggtgagcctcgggctggccgcccgcgagcagctcgaggagatctccgccgcctggcgagaatgggccgccgccccggatggctggatcgccatcccgcacggcgaaatcatctgccgcgcatcggccttcagtcgaggaacaggtccggaatcggttgctcgccgccgccgtagacagacaggtcgtcgaccccggcagagtgcaacacctccgcgtcgatgtagcagtcgccggtggcttcccgcgcggggcgggagacgatctcgacggccgcgtcggccatgatctccgggctgcgcgacgactcggccagcttgtcgccgtcggccatgttggccaccgcggccgtcgcgatataggtctgcggccaaaggcaattcacgccgatgccgtcgtcggcgaactcggccgcccaacccagcgacagcagcgtcatcccatacttggacagcgtgtaggccgggtgggcgcccagccagcgcgggttcatgttgatcggcggcgaaatggtgagcacatgcgggttggcggcgcggcgcaggtacggcaggcacgccttggtgagcaggaaggtgccgcggatgttcacctcctgcatcaggtcgaacttcttggccgacagctccgccgtcggctccaccgcgatggcgctggcgttgttcacgcacacatcgacgccgccgaaccgctgcaccgtggcctcgaccgcgcgccgcacgtcctcttcgcggcgcacgtccccgaccaccgcgagcgccttcccgccggcggcctccacgtcggcggcggcggtgtgcaccgtcccgggcaggcgtgggtgcggggtgtcggtcttggccagcagcaccacgttggcgccccgccgggcggcggcgataccgatggcgaggccgatgccgcggctgccgccggagatcaccaccgtgcggtcggtgagcgagttgtcagccatctgtctcctttgacctggtcaagccacccgcttgaccaggtcaaacaagcggtattggcattctctttttttgcaagtacgttattcatcgatggataatacggcccacactccgtctggcattccgctgcagcccgtctacgggccggcggaccgaagcgctgagcccccgcaaccgggcgagttccccttcaccaggggtaacttcgcctccggctatcgcggcaagctctggaccttccgccaatattcgggattcggcaccgccgaggagtccaaccgccgctacctgctcgagcagggcgggaccgggctgtcggtggcgctggacctgccgacccagtgcggctacgactccgacgatcccgagttcggcgaggaggtcggccgggtcggcgtcgcggtggacaccctggccgacttcgagatcttgttcgacggcattccgctggacaagctcagcaccagcatgacgatcaacggaacggcggcgatcctgctggctttctacgtcgccgcggcggaaaagaagggcataccgcgggccaagctcaccggcaccatccagaacgacatcctcaaggagtacgcctcgcgcgggacgtggatctggccgccggagccgtcgctgcggctgatcgccgacaccatcgagttctgcgcggccgaggtgcccaagttcaacgcgatctcggtggccggcgcgcatttccgcgatgccggcgccaacgcggtgcaggagatggcgttcacgctggccgatggagtgacctactgcgacacggtggtggagcggggccggatgacgatcgaccagttcgccccgcagatctcgttcttcttctacacccacggggatttcttcgaggagatcgccaaataccgtgcgggacggcggcgttgggcgacgatcgtgcgggagcggtacggtgcgacgacggccaaggcatcgatgttccggttcggctgcgtctgcggcggcgcctccctgtatgcgccgcaggcccacaacaacatcgtccgggtggcctacgaggcgatggccgcggtgctcggcggcgtgcagtcgatgttcaccgccgcttgggacgagccgttcgcgctgcccaccgaggaaaccaccaccctggcgctgcgcacccagcagatcctggcctacgaaaccggggtggccagtgtcgccgacccgctgggcggctcctacttcgtcgaggcgctcaccgacgagaccgaggcccgcatcatcgagatcatggccgacctcgaccgccatggcggcatggtgtccgcgatcgaggacggctacctgcaggggctgatcgccgacgaagcgttccggctgcatcaagacatcgaagccgggacccgtcccgtcgtcggcgtcaaccggttcgtgaccgaggagcccgaacacgatgtggtcacctatgagctcgacgccgaagggcgcgacctgcaactcaaacggctgtcgaaggtgaaggccgaaagggattcggccgcagtgaaatccagtctcgcggcgctgtcgcgtgccgccgaaggagacgacaacctgatgcacaagctcatcgactgcgccaacgcgtactgcacggtcggggagatggtctccgcgctcaaggcggtgtggggcgaattccagcaaccggtggtgttctagtggccgtccggattctggttgccaaacccgggttggacggacacgaccggggcgccaagatcgtggcccgcaccttgcgggacgccggattcgaggtcatctacaccggcatccggcagcgtatcgaggacatcgcctcgatcgccgtccaggaggacgtggcggtggtcggcctgagcatcctgtccggcacccacctggcgctcaccgcgcgcaccgtcgaggcgctgcgcgcctgcgacgccgctgacatcgccgtcgtcgtcggcggaaccatcccgcacgccgacgtccccaagctgctcgcggccggtgccgcggccgtattccccaccggcacgccgctggacaaactggtgcgtgagatccgcgcactgaccggcaccggggagccggacgacaaggaagcgatcacggaggaacagtgcgcgtcggagtgatgatcggcgccgagcgcggcgacatggcccgcaaggtgaacaagctggtctccgacatcgaatgggccgagtcggcgggactggacacggcgtggatgccgcaggtgcccaacgacttcgactgcctgaccatggtgtcgctgatggccgcgcacagctcccgcatcgagctgggcaccgcggtggtgccgttgcaggcccagcatccgatcgcccttgcccgtcaagcgctttcgacgcacgcggtggccggtggccggctggcgctgggtgtcgggccgtcgcaccactggatcatccgggacatgctcggcctgccgtaccagaaaccggccgcctacacccgcgactacctgcaggtgctcaacgccgctatcgccgggccgggaccggttgacgtcgagaacgattcgttcaccgtccacaatcccatggtgatcggggccgacaccccgatgccggtactggtggccgcgctggggcccgtgatgctgcagatcgccggtgaactcgccgacggcaccgtgctgtggatggccgacgagcgcgcgatcggcgagcacatcgcgccgaagatcaccaaggccgccgccgacgccggccgccccgcgccgcggatcgttgccggcatcccggtatgcctgtgcgcgccaagccaggtcgacgaggccaaggagcgggccaaccgcattctgggcgaggccgaggtgtcgcccaactaccagcggctgctcgaacgcggcgacgcccgcgacgtcggcgacctgtgcgcggccggcgaacccgaacagattctggcccggatgcgacgcttcgccgacgccggcgtcacggatctgtcggtgcggctgctgcccatcggcgacaaccgcgacgagctggtggcctccaagagccggacccgcgagatgatcgcctcacttgccgcggagttacgttgagcggcaacaacaccgggccgttggcggggatccgtatcctcgaggtcggcaccatgctggcgggcccgtactccaccatgctgctcgccgatctcggcgccgaggtcaccaagatcgaacccgccggcggcgagatctcccgcagcgtcggcgccacctacttcgccagcctcaaccgcaacaagtccagcatctgcctggacctcaattccgatgcgggacaacggcggctgggtgagctcgccgccgaatcccacgcactgctggtgaacctgaaaccgtccgcgatccgccggctccggctcacctacgacgacctgcggcggcacaacgagaagatcgtctgcgttgccatcaccggtttcgggctgtacggcggcgacgatccggccttcgactacgtggtgcaggcgggcgtgggcaccgccgcgctgaccggcgacccggatggcccgccgacgctgcccggctattcgtcggccgacaactccaccgggatgtgcgcggcactggggttgctggccaagatcatctcgggcaccggcggccaggtggacgtgtcgctgcgcgacgtcatgctgtcgcagctgaactaccacgcgtcggcgtacctcaacagcggcgtcgagccgcagcgccgcccacacggggcgcactcctattacgttccggcgcagctgtttccgaccgccgaagggtatctggcgctgttcatcacccacgacggcttctggaagtcgttcgcggcggaggcgggtatcggggggtttgaaaccatggcggagcgggtggcccgccgcgacgaggtgctggccgtcgtcaccgcgatgctgtccaccgacagcgccgccgggtgggaacggcggctgcgtccgctcggggtgccggcggcggcggtcagaacactgcccgaggcgctcgaggccactccggaagtcattgtgaccgcgggggaattccgtctggtcggcagcccgatccacgtgtcgggataccagcccgagtaccgtccgccgccccagctgccgcagtcgtagggcatcaccgccgccgagcgtggaactaagtgcacgctcgcgcggcggctgcgcccgcggcggctgcgcccgcctcgcctacgtctgccccgccagctgcttctcgtggtagcgccgcgcccactcggcgcgcgaccggatggacacgtcgacgtcaagagccttggcgcgcaacgctttgacggtcgcttgatcgcggggcgtgcgggcgaacgggtcccagctgaagaaccggcaggcattcgcccaggtgattttgttgatgtcggcgtcatcggcgccggcggcggtcagttcggccagcacctgctcgggcgcatccggccagaagcagtccgagtgcgggtagtcgcactcccaggcgatgatgtcgatgccgatctcgtggcgcagcttcagcgacgtcttgtcggtcacgtagcaggccagcgagtgctcccggaacacctcgctgggcagttgagagccgaagtcgcggcgcagccatttctggttggtgtagtgccggtcgctgcggtccaagtagaacggaatccagccgataccaccttcggagaaggcgaatttcaggtcggggtagttgcgcatggccggaccccacagcaggtcctgggcgcacatcgccgagacctgggtggccaggatgatcatgttgtcgatcggcgcgttgggggccatgctgatcgccccgaacccggtgccgatgtgcaggcacatcaccacgttctcttcggacagggtgcgaaacaccggaccccaatagtcctcgtcgtgatagctcggaagtccttccaaatgcggcaattccggcatggtgaccgcccggcagcccttggccgccacccggcggatctcggcgcacatcgcctcgggattccacgtcggcaggatggcgatcgggatgaaccggtcgggataggaacccgcccactcgtcgatgtgccaatcgttgtaggccgacaccatcaccagcgtcacctcttcgcggtgcatgttcaggtgccgggccgagaagccggtgaacgtcgggaaacacatcgacgccaggatgccgttgcggttcatgtcccgcacccgctcgtggacgtcgtagacgccgggccgcatctcggcgaacccggccgggtcgcggccccactcctcggccggccacgacaccacggcgttcagtccgctgacgccctgcggcctgccctggtacatccactggtcgacgcccttgtcgtcggtgacgacgatcggggcctcgtcccggtatttggcgggcacgtgccgcaggaacatgtccggcggctcgacgacgtggtcgtcgatgctcaccaggatcaggtcatcggccttcatgggctagcctccgcactcggtggtcacttcgagcagtcgtgggatcggcgccggatccagctgcagggcatccgacatgtgcagctgcccggcgctggcgatcatgttgtccagaatcgcctgcaggtcgtcgccctcgatctcgtagatggcgacgtaggggccgtcgccgtccaccggccgcagccggcgcgcggagacgaatccgtccagggccaccagctcacccaggtgcacctcgtcgtaccaggtgttgtattcctgttcccgctcaggcgaactgggtcgactctccacgaggatgatgcccttggccattgccgccacctctctggctactcgtagcgcaccgtgaccgagtccgtgtccggaacgccctggcacgtcagaatgtagccctcggcgacttcgtcgggttccagcgcgtcgttggcccgcatggtcgcgtggccctcttcgagcttggccatacacgtgccgcagttgccggcctcgcagctgaacggcggttccagcccggcccgccgcgcggtctccagcagggtctcgccgggcaccatgggcaccgagaccttcttgcggtccagatgaatcgtcaccgttccggcgctcgagccgttggttgccggatctgtcacccgtggggtctcctcgatgatccgggtgaccgtcactttgaccgccccctcacgtacttgcattcttcagtatagagaatactattctcacggagcgatagcatcttctcaagactgtatggatgtcgggtctgcccggcctgtcagggaaggacgggacgtgaccgagccggcagcgctcgtgttcgaggaacggcgattcagcgtgcccgaactcgacgcattggccgacggctgggccgccgcgctggccaaggacggtgtcacggccggtcgacgggtcgcagtgatgacctccaaccggcccgaattcctggccgtgctgctcgccatctggcggttggccgccacggccgtgctcatcagcccggcgtggaagcgcgacgaggtcgagcatgcgctcgcgttgaccgatcccgggcacgccgtcggggaccatccggtgctggccggcctgatgccgatgctgcacctggacgagccggtcccgcccgcgcagccgacggccggtgcgccgccgcgcgccggcgacgcggtgctggtgttcagctccggcaccaccggcctgccgaaggccgtccggcacacccacgcctcgctcgacgaggcggtgcggcactggcgcgaggcgctgcggctgacacgccgcgaccgaatccaggtggcgacgccgccgtcgcacatcctgggcctgctgaatctgctgaccgcgctcaagaccggcgcctgcgtgcggctgcacccccgcttcgacatcgacaaggtgttgcaccacatcgaaagtgaccgcgtcacagtcgaaatggcggtggcgccgatcgcactggccatcgcctcccatccggatctcgagtcctatgacctgtcctcgctgcgctacatcgtgtggggggcaacgcccgtcaacgctgaggtcgcccagacggtgacccggcgcaccggggtgggttggctgcccgcctacgggaccacggaattgccggtgatcgcgtgtaatccgatcgaggacgcgcggctggacaccgtcggacggccggtgcccggcgtcgaggtgcgggtcgtctcgctcgcgagcggcgagccggccggagcgggcgaggtcggtgagatacaggcccggtcggcgtcgctgatggccggctatctgccgggcgaggcgacgggcgaggcgatccgcgacgggtggtaccggaccggagacgccggctggctggacaccggcgggtggctgcgcatcaccgaccgtctcaaggagatgatcaaggtgcgcggcttccaggtggcgccggccgagatcgaggcggtgctgcaggggcatcccgccgtcgcggactgcgcggtgttcggcgtgcccgacgggctcaacggcgaagccgtcgtcgccgcggtcgcggtgtccgcaccggtggacgtgaccgagttgaccgccctggtgcgccaaaagctggcgtcctacaaacatctgagccgagtggtggtcgtgcccgaaatcccccgcctgccttcgggcaaggtgctgcgccgagtgctgaaggagcgccatggatgtacgtctgacagctgaacaacagcaattgcgtgatgccgccgccaagctggccgacgacctcggcccggcaacggtgcaggatctcgacgaccagggccgaatcagccggctggacaagcagatcgagatgtccggctggcggtcgttgcgctccgacggcgcctcgggtgtcgaagtggccatcgtcgccgaggaattcggccgccggctggtcgacacgccgtttctgggtccggtgctcgccgacgacctgctccgccacgtcggcgccgacgcggcggcgacgacggtggccgtcgacgatcgggcggtcgatgcccggggcgctcggcgcgccgtctccctgtcgggtggcgcggtcctggccgccgatgtgcggcccgcgccggacaacgtcgacctgacccgggccgacgcgacgacggtgggctctccggagacgctgggggaggtgggttccgacgtggccgggcagtggcgggcgctggcgctggtcaccacgacggccgacctggtcggcgtcgcccggggcgcgcacgcgctggcctgcgactacgcgaaaatccgtgagcagtacggtaatccgatcgggtcgtatcaagccatcgcgcacctgctggcggaaagccttgcgctgatcgagggttcgatcagcgtggcccggcacgccgggtgggcggtggacgcgctggcacccgccgaggccatccgggcggcccagatcgccaaggtctactgtgcgcgtgccgcccgaacggtctgtgagacggcgattcaggtgcacggcggtatcggcaacacctgggagtgcgcggcgcacgtctacctgcgccgggccctgacctcgaccgagctgtggccggtcgcgttgaaggagatcgatcttggactttcgtgattcacccgacgaggccgccttccgggagcggctgcgctcttggctttcgttgcacgccaaggagtttgccagttccggtgacgactactgggcccggcaggccgagtggcaccaggccctgtaccgcgagggcttcttcgggctgtcgtggccccgcgagtacggcggccaggagctggcgccggtgtacgacgtcatcgtggacgaggaactggcccgggccggggcgccgccgcggcccagcgtgggctatctgatctacggcatcggccggcacgccagcgacgaactgcgccggcgcttcctgcccggcatcatcaatggcaccgagcgctggtgtcagggcttcagcgagccgggcgccggttcggacctggcgtcgctgaccaccaccgcccggctggagggcgacacctacgtcgtcgacgggcacaagatctggaccagttactccgatgtcgccgactggtgtctgctgctggcccgcaccgatccgcaggccaagcgtcaccgcggcctgtcggcgttcatcctcgagatgaaacagcctggcgtacaacagcgtccgctccgcatgatcaacggggtgaccaacgaattcggtcaggtgttcttcgacggcgccaaggttcccgcggaccggatggtcggtgcccccggggacgggtgggcggtggccatgacggtggtcgggcacgaacgcgagccctccacgctggggtatgcggctcgctacggcaagatcgtccgcagcctttacgcgcgcaccgacggcccggtgtgcgaggaattggcttgggcggcagtgcaatcggagatgctcacgcatcacgtccggcgacggctgtccgagcagctggacggcgtgtcgcacgggcccgagggatcgcttgacaagctgctgatgacctgggtcgaacaatccgtcggccatgccgcgctggccgtcgcgggcacccgggaccccgatctgctcagcgcctacctgtacagccgggcgcaaagcgtcatgggcgggacatcacaaatacagaagaacatcatcgcttcacggatcttgggattgtaggagtgatcgcgagcgcgggcgaagcccgggtgaagcgggtcacgaccattaaacaaggagtgatcgcgagcgcgggcgaagcccgggtgaagcgggtcacgaccatctaaaggagtctgacgtgtacgacatgcctaccgaaatcgatgtccgggccgacggtgcgctgcgcatcatcacgctgaaccggccggactcgctcaactcggtcaacgacgacctgcacgtggggctggcgcggctgtggcagcggttgaccgatgaccccaccgcgcgtgccgccgtgatcaccggtgccggccgggctttttcggcgggcggcgatttcgggtatctcaaggagctgtccgccgacgccgacctgcgcgccaagacgatccgggacgggcgcgagatcgtgctgggcatggcgcgctgccggattccggtggtagcggccgtcaatggccccgcggtagggctgggctgcagcctggtggcgctgagcgacatcgtctacatcgccgagaacgcctacctggccgacccgcatgtgcaggtgggtctggtggccgccgacggtgggccgttgacctggccgctgcacatcagcctgttgctggccaaggagtacgcgctgaccggcacccggatcagcgcgcagcgcgccgtcgagctcgggttggccaatcacgtggccgacgatcccgtcgccgaggcaatcgcctgcgccaaaaagattttggagctgccgcagcaggcggtggaaagcaccaagcgggtgctcaacatccatctggagcgggccgtgctggccagtctggactatgcgttgtcggccgagagccagtcgttcgtcaccgaggatttccggtcgatcgtcaccaaactggcggacaagaactgaatcgatcagtcgtgcagccgtaagaagtcacgcatcaccgcgtcgaacttctccggttcctcgatgaacggcatgtgggcgctggactcgaacagctcgaagcgcgagcccggtatgcgccgatgcatctcccacatgtgctccggcacgcattcgtcgtagcggcccgcgagtaccagtgtgggcacggcgatttcgcccagccggtcgaagacgtcccagtcccgcaccgtgccgacgatgtgaaagtcgctggcgccgaacatcgtctcgaagacctcggcgctcattttgcggaacgcgtcctcgaggtcgcgcggccagggccgcacccggcacaggtaggtttcattccaggtgcgtatcgcggcctggtattcggggtcatgcgtggtgccggcggcctcgtgacggttgatggccgcctgtgtggcggggtccagctcagacttcaagcgcgccaccatcttcgcgaactgcgggatggaggcaatgctgttggagatggtgaggctggcggcgccggccggagccgcgtccagaacgtactgctgggctagcatcccgccccaggaatttccgaacagatggaagcggtccagccgcagggcgcgcaccacggcatccacctcggccaccgagcgttccatggtccaaaggccggggttcggtgggcatttggagttgccgcagccgagctgatcccagaagatgacctcgcggtcggtggccaaccgccgcagcgaccgcaggtagtcgtgcggtagacccggcccgccgtggatgacgagcagcggaagcccggcgccgccgccggtgcgctggaaccacacctggccaccggggaccgcgaccattccctcagtcatccacccaccatcccaaatcggaccgattcccgcagctcccgggggagtgcggttctggcaagatctcccctgagcccggcccgctcggccggaccgagatgggaggaacgaacatgaccagcgtcgcgaatccgattcccccgcaagacttctcggggatcgtcggacaccgcttcatctacacttacgccaacggttggcagtacgaaatgtatgtcaagaacgccaccaccatcgactaccgcatccactcggggcatgtcggcgggcgctgggtcaaaggccaggaggtcaacctcgtccagctcgacgacgacagttacaagatctcgtggaccgagcccaccggcacctgcgtcgcggtcaacgtcctgccgtccaaacgccgcattcacggcgtcatcttcttcccgcagtggattcgccagcacggcgagcgcacggtctgcttccagaacgaacacctcgacgagatgcgggcctaccgcgaccgcggcccgacctacccgatctacgaagtccccgagttcgcctacatcaccctgttcgaatacgtcggcaccgacgacgagaccgtcatcgacaccgctcccggcgacctcccgcggggatggtccgaccgcaccaactgacccgccggccgccaccccgcgctggttgcaactgacgctctcctactgagagaataatattctcgtgaggtgcggatggcgcacgggcgctgcacctgctggttgaactggagaagactgtggctgaagccgtcatcgtgtccgcgctgcgcacacccatcggaaccgcccgcaagggcaccctgcgcgacaccagcgcattcgacctggcccaccacgtcgtcagcgaagcggtgaaagatattgacccgacccaggtcgacgacgtgatcctgggcgagggcctctacggcggcggcgtgctggcccgccacgcggccatcacggcggggctgacccaggtgcccggcctggccaacaaccggcactgcgcggcgggtcaggcggccgtacagagcgccgcggccagcgtgcgcgccggaatggaccaactggtcatcgccggcggcgtcaactcggcttccacgtcgccgcgatcgcggatgcaggtcgacggcgagtgggtcgactggttcccgccgacccacccggaccggcccgacgccccgaacatggacatgtcgatcaccgtcggctggaacgctgccgtcaaagccggggtgagccgcgaggagatggacgcctgggcgctgcggtcgcaccgcaacgccatcgccgccatcgacgagggccgcttcaaagaggagatcgtgcccatcgacaccccgcacgggctgttctcggtcgacgaacacccgcgccgcgacaccagcatggagaagttggccgcgctcaagccgttacatccggaaatcgagggcttctccatcaccgccggcaacgcctgcggcgccaacgacggtgccgcggtgctgacgatcgccagcgaccggctcgggctgcggccgttggccaccatccggtcctgggcgtcggtcggggtcgacccggcgatcaccggcctggcgccggtggaggcgataccgaaagcccttggacgcgctgggctttcgatctccgatgtggacctcttcgagatcaacgaggccttcgcggcgatgtgtgtggccacggtcaagctgctcgaactcgacccggacaaggtcaacgtcagcggcagcggctgctcgctggggcatcccgtggcggcgaccggggcccggatgctggtcaccctggtgcacgaattgcgccgccgcggcggcggtatcggcgtcgcggcgatgtgcgcgggcgggggcatgggttcggcgacggtgatcgaggtcgcgggcgaataatgcgcacatgaccatcggagagctgatcgaccgggcgcgcaacggatctccccgggcggccggtcggctgctcagcctcgtggagggcgagcggcgcgacgaggtcttgacggcgatcggtcccgcgccccgcgacacgggcccggtgatcggcatcaccggaccgccgggtgcggggaagtcgacgacggtggccgccctggtcggcgcctaccgccgacgcggatgccgggtggcggtgctggcggtggacccgtcgtcgccgttcagcgggggcgcgctgctgggcgaccggatccgaatggccgcgcatatcaacgactccgacgtgttgatccgctccgtggcgacccgcgggcatctcggcggcctggccgccgcggttccggcggccatccggctgttggcggcgatcggctacgacgtcgtcctgctcgagacggtcggggtgggccagtccgagatcgagatcgccgccgtggccgacccgaccgtcgtcatcctcaatcccggtgccggcgacgcggtccaggccgctaaggcgggggtgttggaggtcgccgacatcgtggccgtcaacaaggcggaccgcgacggcgccgagcagacggtccgggatcttcgtgccgaaaccagcgcccccatcgtgtcgttgatcgccgcccggggcgagggcatcgaggacctgatggcggtcatcgaggaccatcgccgcaccgacagccgcgcccgtcgactggcgcgcgcccgggcccagatcctgtcgctggcgcagacccggctgcgcacccagccggccctcgaccggctcgccgaggccgtcgtcgacggcacccaggatccctacaccgccgccgaccggctgctctcgccgtcgaggaccgagacggactgaccgccggcggtgtcccccaatcgggggaacgggcattcatcacgtttgcggaccgatcggcggaggcgcgccgcgggctatccccctaccttgaggaccaagcaaatcgcttgcgactcaggaggtccggcacatgacagcacccgaacacgacgaccggctggagccctaccgccggatgtgggtcttgcggctgctcgacatggcgctggacgaatcaggcgtcggcgccgcgatcgacgacgacgcgccggtggacttcgggcaggaggcggtcgccgtcggggcggtcgccgcgcttcgaccgggagacctggtcaacgcgactaccccgcgattccggcacgcccagcagatcggcctgggcctgccgctgggcccggcgatcgcggagttgctcggaaccacgcgcggaggcgccggcggatcgcggaaaagcggtgcggctgactggaagcaggcgctggccaacgaaagcgcgttggggcaatcgaccctgtttgcgctcggcgacgccaacgcgcagcggatggccggtgacggcagggtcacgctgtgtgccatcgcgggtagtgacacgcactccgtcgagttcgccacggccgcaaagatcgccgcgtcgtggcggttgccggtggtgttcgtcgtgcagaatgtccgcggcggcccggatgcccggcggtgcgcctaccggtccgagacgatgcccatggcgttggtcgacgacagagacgttgtggccgtgggtgattcggtgggccaagcggtacggcgcgccagcgccggcggcgggccaagcctggtcgaggcgatcacctaccggacgaaccaccccgtcgccatcgacccgctggtcctggcgcgacggcggctgatggccgacgggatcgatcccgaccggctcgtggaggtcgaacgcggagcccggcatctggtggccgaggcgatggcgtgcgcgaaagcgctggtgcgagcgcggcggttcgatgcggtgagcgcacccgaccgctggtcggctgctagctgagcagaccttggcgcattgcctcggcgacggcggccgcgcggtcgctgacccccagcttctcgtagaggcgttgcacgtgggtcttgaccgtcgacggcgccacgtagagctcgcccgcgatcgcggggatgctttgaccgcgcgcgatccggtggagcacctcgcgctcgcgcgcgctcagcaccggccccgtcggttccgcgcgctggcggatctcggcggcaagaccgccgacgagcgcgggtgccacgacgtcgcggccctgcgcgcagtcgagcacggccttgacgatctcgctgcgcgtcgagtccttcaacacgaacccggccgcaccctgctgcagcgcctggtagacgatcgccgattcgtcgtgcgccgagatcagcaacacccgggtcgccagcccgtcggcgcgtaccgccgcggccacctgggcgccgtccatgccgggcatccggtagtcgagcagcgcgacgtcgggctggtgcgacttgatcaattccagtgccgcagaaccgtcttccgcctcaccgaccacgttcaccgcgccgctcgacaccagcgcccgcaccacaccttcgcgaaacagggggtgatcgtcggcgacgaccacccgcaccgtctcgcgggtagccgggtcagccatggccgacagtgtagctctttgccgaacaacggcgttcgccacgattgggcgccccgatgagtcgtcttctcgtttgcttggggtcgaccggcgcggatgagtacggtgatcgggtggcggtagccggggacgcagagctggagcgggtacgcgcggttcaccaaatgcgctcgtaccgaatcggctcggtgctgcgggtcggcgtggtgggcctgatggtcgcggcgatgatcatcggcaccgcccgatccgagtggccgcaggaaagcgtgttgatcctgctgtacggaatcatcgccctcggtgctgtggcgctggcgttcgcgccgtttcgccgctggatcgggaccggcagattggccggggtcggccggctggagccgttcgcgttcacggtcgtcgacatcctggcgctgacgatctttcagctgctgtccaccaacgggatctatccgctgctcatcatggccatgctgccggtcctgctgggactggacgtctcctcccgccgggcggccgtggtgctgatcttctccatgctcgggttcgcgattgccgtgctgcaagatccggtgatgtcgagctcggtgcgcctgccggaagcgggttttcggttcctgctctacggctttctctgttgtgcggcatttttggtggtgcgcatcgaggagcgtcatacccgctcggtggccgggctcagcgcgttgcgggaggaattgctcgcccagaccatgaacgcgtcggatgtgtcccagcgcaggatctcggagttcattcacgacgggccgctgcaagacatcctggcggtgcgccaagagctcgtcgagctggatgcggccgtgcccgatgacgaacatatcggccgggcgctggccggtctgcagctggcctcggagcggttgcggcaggcgacgttcgagctgcatcccgcggtgctcgaacaggtcgggctgggtgctgccgtgcagcagctggccgaattcaccgcgcagcggtccgggatcgaaatctccaccgacatcgactattcggggcgcagcgccatcgacgcggtggtgttcggcgtggtgcgcgagctgctgtcccacgtcgtgcagcattcgcgggcccgcaccgcggcgatcatgctcggccgcaccgacgggacgtgcgtcctgcacgtcgtcgacgacggcgtgggcttcaaccaggagacggtggcgcgccgcttgggcgaggggcacatcgggctggcctcgcatcgcgcccgggtggaggccgccgggggagagctggtattcctggatgttccggtgggcacgcacgtgtgcgtcgaggtgcctctgagaaactaaccgcgccgatcgctgctgcgcgtcacattggtcacgtcggcaccaatttggctgccatgaagtgagtttggattgcgctagcacccgcgctatcggttgccgctcaccgcaccgccgttccccgtcgagcgtggggcctatggtcgtccagccggcagtttcgggacgtaaggcccacgctcggcgcgaagcgggggtgcgaaaccgggcccactcgctcggcgcgaagcgggggcgcgaagcgcccaagccgccgctattgcaagtcgaccgatttgccggtggccgcggcgtggccggcgcggtacccgaaaaccattgccgggccaagtgttccgccggcgccgccgtacgcgcgtccggtcaccccgcccatcgcgttgcccgcggcgaagaggcccgggatcggctcaccgcccacatgcagcacgcgcgcgtcgcgatcggtgcgcgggccgcccttggtgcccatcgcgccgatgctcaccggcaccgcgtaatacggggcggtgtcgatcggcccgagcgtcttgcccgcctgagtggtcgcgctgtcgtcgccccagtagccgtcgtaggcactggagccgcggccgaagtcggggtcgacgccggccaccacataccggttccagttctcgacggtgcgggcgagaccgtcggcgtcgatgccggtcttggcggccaactcggcgaggtctgccgactcgcagaaccagtccggaaccggttgtcccggttcgacacccaggaatccgtagcgctgcaggtgaaccgagtcgaacaccatccacccgcggtcgttgacgtatccgccgcgcggatccaggtagtggaacgcgccggccatcgagttgtagtcgcatgcctcgttgacgaagcgccggcccgccgcgttgacgatgatgctgcgcggccgcgtcctttccagccgcacactgcggctgcgcggcttgccgtcgatggtgtcgcccgggatctggacgatgggcacccaccacgcttcgcccatgttggccagatccgcgccgtgcgccatcgccatccgcagcccgtccccggtgttgttgggtggcgagaccgcgccatgcatggggccgcgcagaaacgcctgcaccagaacgggatcccactcgaaaccgcccgtgcccaggatgactccgcgccgcgcgcgaacgccgatgcggccctcggccgaggcgatgcgcaccccggtgatctccccgtcctcggcgacgagctcttcggcccgcgcgttcacccgcggcgtcaccccgaggtccagcaggcccttgaggaggccggcgatcagcgcggtgccggccacgcacaggtgacctgttcgttcgtcgatcgcggcgtgcagccgcgcccgggtctcggcgtcgaacccgacgttggaccagtcggcaggaaaagacgttatccgcgttgcccattcgcccagttgggcaaggtcgaagggcaccgcgctcagcgatcggccacccctgggccgtcctcccggcagctcgggccggtagtcggggaagccggtcgcgatctcgaagtgaaggccgctgtgcgcctcgatgaagtcgagcatcgccgggccggtgcgcacgaacgtctcgaccaactcgtcgtccatcgaaccgagggactgcgcgcgcagatacttcaacgcgtcggcggccgtcaattccccgtcgggacaacggttgtgggccggtatccacacgatgccgccggacacggcagtggtgccgccgacggtcggtgccttctcgtaaacctgcaccgaggcgcccgccacggccgcggtcagcgcggcggtgagaccggcgccgccactgccgagcacgacgacgtcgacttcgtggtcccatgacatggactgcaatcccttcagctcaacagctttgataactgctccgcggcccgcatgaccgcatccttgccgcgcatcacgacgtcttcgcggtgcgagatgaggttgatacaggtgggcggggacggcgccgggcggcgcacaccgacggccaggccgtaggtgttcggttcgatctcgccgtacgtcgtcacccaaccacgctcgcgtgcccgcgacaccagctcacgttcccccggccgcggcggcatgcacgcgagcagggcgatgccggcggcgccgcggtcgagcgggtaccggctgccttcgtgaaaggacagctggtaggcgacgtggctggggacgatcaccgcgatcgccacttgctggtcgccctcggcaacgagcagggacaccgtggtgcccagctcgtcggccagcgcgcgcagcgtcggcaggcacagctgccgcacgttgcggtcgaaggacgcgccgagcacggccagaccggccgcggggcggtagcggccgtcctcgcccttggccaccagccggaactccgccaacgtcgtcagcaaccggtaggcgatcgtgcgatgcacgccgacctgatcggcgagctgctgcaccgtgagtccggcgggggcatccgccaccatctgcagcgcggtcagacccctggccagggtctgcgaaccggtcccggaacccgtcacagccttgacagaccttcccgtgagagcgaagctctatatatagcgcacgtcactgtgcgatattagcgcacacgtaggtcgaaaacgagaacgagatttccccgatctggaggccggacggaaccgtggcggagttcgagagcatatggagtgacctccagggcgtcgcgttcgagcagggctacctcgatgccggcggcatccggacccgctacctgcgcgccggcgatcccggcaagccggtgctggtcctgttgcacgggtccggcggtcacgccgaggcgtacgtccgcaacctggccgcgcacgccgaccatttctggacctggtcgatcgacatgctgggccacggctacaccgacaagcccggccatccgctggaggtccgccactacgtcgagcacctgatgaccgtgctgcgcaccatcggtgtcgagcgcgccagcatcagcggcgaatccctgggcggctgggtggccgcccgcgcggccatcgaccatcccgacgtggtagaccggctggtcctcaacaccgccggcgggtcgcaggccgatcccgttgtgatgcaacggattatcgcgctgtcgatggccgccgccgaaaaccccacctgggagacggtgcaagcgcggatcaaatggctgatggccgacaagtcccgcgactacgacgacctggtcgccagccgccagcgcgtctaccgccaaccggggttcgtcgccgccatgcgcgacatcatggcgttgcaggaccccgagattcgggcgcgcaacattctgggcccggccgaatacggctcgatcatcgcgccgaccctggtgctgtggacgagcgacgacccgaccgccgatgtcagcgagggccgccgcatcgcgtcgatgattccgggcgcgcgtttcgaagtgatgcccggctgcggtcattggccgcagtacgaggacgccaagacgttcaatcggctgcatctcgatttcctgctgggccgctgatgatcgcgccggggccacgggcaaccgaccacgacaccgacgtcctggtggtgggtgcgggtccggtcggcctgacgctcgccaatatccttggcctgcaaggtatccgcaccgtggtggtcgaggagcgggacaccctgatcgactacccgcgaggggtgggcctggacgacgaggcgctgcgcaccttccagtcgatcgggcttgtcgagcgggtgctgccgcacaccgtgcccaaccagatcctgcggttcatggacgccaaacgccgggtgctcgccgaaatggccccgcccgacgcgcgtttcggctggccgaagcgaaacggattcgtgcaaccgctcgtcgacgccgaactgctggccggactggaccggttcgcgcacgtgcaggtgcgctggggcagcccgatgacgggctgccgggaagacgccgacggggtgaacgtcgaactcggcgccgacggcggcaatgtcggcgatggcggcggtgacggccaccctgcccggctgcgcgcccgctacgtcgtcggttgcgacggcgggcgcagcatgacccggcgggtgatgggggtgtccttcgacggcacgacgtcgtcgacccggtggctggtggtcgacatcgccaacgatccgctcgggcatcccaacagtgaggtcggcgccgaccccgaacgtccgtacgcctcgatctcgatcgcgcacggaattcgccgcttcgagttcatgattcacgccgacgagtccgacgaacaggccgaagacccggaattcctgacgcggatgctggcccggatggtgccgcaccccgaccgggtcgacgtgatccggcgccgggtgtacacccaccattcgcggatcgccggcgagttccgccgaggccggctgctgctggccggcgacgccgcgcacctgatgccggtctggcagggacagggctacaacagcgggatccgcgacgcggcgaacctgggctggaagctcgccgcggtggtgagcgggcgggccggcgacaagctgctggacacctacgacatggagcgccgcaagcatgcccgcgcgatgatcgacctgtccacgatggtaggccgggtcatctcacccaccaaccgccgggtggccggcgcccgcgacctgctggtgcgctcggcgtcgatcgtgccgacgctcaagcggtatgtgctggagatgcggttcaagcccatgccgcgttacgagcaaggcgccgtcgtgcacgccaaccccggccgggccgactccccggtgggcacgctgttcatccagccgcgggtggacacccgcgaccagcaggacgtgctgctcgacgacgtgctgggcccctggttcgccgtgctgtgctggaacaacaacccgcgcaagatcctcggcgagacggcgttcgcgaactggaaagccttgggcgcccgcttctttgcgctgcgcccggccacacagttgcactggaccgggcacgacgatcccgacgtcgtggtcgtcggcgaccggcgcggtgacctcaaatcctggttcgacacccacgctgaatcggtgctgttcctgcgtcccgatcgatgcatcgccggcgcctgcatcgcacagcgcgcgcccgacctgagcgcggcgctgttcgacgcgctgacgctcacgccgcgaggaggtgatccgcaaagtggcactggctctgtgctgtatgtcgcacagcccgctcctgaatcttccggggccgtcgcgggacctgcttgacgacatcgacgccgccatcgcccgggcgcgaggcttcgtcgaagactacgacccgcagctcgtggtcatcttttcaccggaccactacaacgggttcttctacaaggtgatgccgcccttctgcatcggcagcagcgccagcggcgtcggcgattacggcacccacgccggaccgctggacgtcccggagaagctggcggtcgactgcgcgcaagccgtcctcgacgccggggtcgacatcgccgtgtcggccagcatggacgtcgaccacgggaccgtccagccgctggaaaagctgttcggcacggccatttcgcgtccggtgataccggtcttcgtcaacgcgatcggggtgccgcttgggccgatgcaccggtgccgggcgctgggcgccgccgtcggcacctatctggccacgctggacaagcgggtgctggtgatgggatccggtgggctctcgcacagtccgccggtacccaccctggccaccgcgcccgagcccgtgctgcagcggatcgtgcacggcgcgccgatgacggccgagcagcgccaggcccggcaggccgcggtgatcgacgcggccaggagcttcgccgccggcgacagtgcgctgcagccgctcaacccgacctgggatcaccggttcctggaaatcatcgaccgcggctcgctgagcgaattggaccgctggtcgaattcgttcgtgacgcacgagggcggcggctccgcgcacgaaatccgcacctgggtggccgcattcgccgcactgcaggcggccggtccctacgagacgaccatgcgctactacacgcccgcccccgaactgatcgccggattcgccatcagaacggcaagaccgaaatgaccgatttcgaccacgtcgtcgacgtactcatcgtcggttcgggcggcggcgggatgacggccgcgctcaccgcccaggccgccgggctggatgcgctgatcgtcgaaaagtcctcccacttcgggggttccaccgcgctgtccggaggcggcatctgggtgcccggcgcgccggcgcagcggcgggagggctactcgccctcgccggaaggggtggtggaatacctcaaacacatcaccgacgggctggtcagcgaggcgcggatacggcaatacgtcgagaccgcgccgcagatgctggcattcttggaaaacctctccggatggttcgaattcgtctggaagcccgggtatgccgactactatcccgagctgcccggcggctccgaactcggcagcaccatcaacgtgccacccatcgacctgcgcaagctcgggcccgacgagcacacgctgctgcagccgctggccctggcccccaagggaatctggctgggccccaaggagttacgcaccttctaccggatccggcagtcctgggcgggcaaagccgtgctgctcaagctgatcgcccggatggtcagggcacgggtgttcggcgagcggatggccgcgatcgggcagtcgctcgccgcccggatgcggctggcgctgcgcgaccgcggtgtcccgctgtggctggactcgccgatggtgcggttgctcaccgacccgcagggagcggtcagcggcgcggtggtggaacgcgaaggcaagccgcagcgcatcggcgcacggttcggcgtcatcctggcctccggtggcttcgaccacgacctcgcctggcgcaaggagctactgcccgaggtggaccaggactggagcttcggcaacccggccgcgatgggggacggcatccgggccggccaaaacgtgggcgccgcaacggacttgctcgacgaggcgtggtggttcccggccatccaatggccggacgggcgcatgcaattcatgctcaacgagcggatgatgccggcgcaattcatcgtcaacggcgccggccgacggttcatcaacgaggcggccccgtacatggacttcggccacgccatgatcgagggccagcggtccggtgtcacccacatcccgtgctggctgatcaccgaccacaggtcgtggaaccgctacgtcatcggcgggcacctgccgctgccgaagatccccggggcgccggtgcccaccggccgcaagatcccgccggcctggctggaatcgggtgtcgtcaaggccgcgatgacgtgggacgagatggcggcgcagatcggggtgcccgccggggagctcgccgaaaccgcgcgacggttcaacgaactcgcccgcaagggccacgacgacgatttcaaccgcggcgacagcgtctacgacaactactacggcgacccgaccttgcccaaccccaacctgtatccgctgggtgatccgccgtattacgccttccgaatcgtgctcggggacctcggaacctcgggcggcctgcgcaccgacgaacacgcccgcgtgctgcgggccgacgacaccgtggtgccgggactctacgcggtgggtaacacctccgcgccggtgatgggccgcagctatgccggtgcgggggccaccatcggccccgccatgaccttcggctacgtcgcggcgaaacacgttgcggcccaagtcgccaaccgagccgctaatactcataggaggtagcacatgaaaatctcgctgttctacgaattcgccctgccgcggccctgggcccccgacgacgagcacgtcctgctgcaggaatgcctggacgaggtggaggcggccgacaaggcgggtttctccaccgtctggctgaccgagcaccacttcctcgaggagtactgtcactccacggcgccggagatcttcctggccgccgccagtcagcggaccaagaacatccggctcggtttcggcatcatgcatctgccgccggcggtcaaccaccccgcccgggtcgccgaacgcatcgccaccctggacctgctgtccaacggccgcgtcgagttcggcaccggcgaatcgtcgtcggtcggtgagctcggcgggttcaacatcgaccccgccgacaagcgggcccagtgggaggaggccctcgaggtcgcgatccgctgcatgatcgaggaaccgttcagcggattccacggcgagcacgtccagatgccggcgcgcaacgtcattcccaagccgctgcaaaagccgcacccaccggtgtgggtggcctgcacgcggccggccagcgtacagatggccgcccaaaaggcaatcggcgccttgagtttcgcctacaccggccccggcccgctgaccgagcgcgtcaacggctactacaaggagttcgaggagaacggcgtgcccgtcacgccggcgatcaacccgaacatcctggccatcggcggtgacctgtcgatgatggtggcaaagaccgacgaggaggcgctgcagcggctcggcaagggcggcggcttcttctcgttcgggatcatgcactactacatgaccggcgtgcacacgcccgggcggacgggtgtgtggaagcggtatctcgaagaggtggaaaaggatccgacgctggcctacggccccgggcggggcgcgatcggatcgccggccacggtgcgcgagttcctgcgcggctacgaggaaagcggcgtcgacgagatcatcctgctgctcaacccgcgcagccacgagggcaccatggaatcgatcgaactgatgggcaaagaggtgctccctgaattcatcgagcgggatgcaaaagccgtggccgacaaggccaccaggctggcgccggtgatcgaaaaggtggaggcgcgccggccgaagtcgaccgcgccgcagttcgacgagaattactcgttcggtggactgcccaccggccggggcggtaagttcaccgccagcgagatccccgaggccatggcggagatcaacgaaggccgggtccaggccgcgcagcgggcgaaggaacaacagcagcagaagaagtagttctcaacggatttcggggcgaaacgtggcagagatcgacgcgctgtggcgctatgaccgccgccgcgcggtggtgaccggatgcgcgtcgggcatcggcgagcaggtcgtgcgccagctcggccaactcggcgccgacgtgatcgggttggaccagcgccggcccggctgcgcactcggcgagttccacgaggtggacctggccgatcccgagtccatcgatcgcgccgcggccggcatcgacggccccgtcgacgcgctgttcaacatcgcgggcgtgtcctcggggatcggcaacccgccgctggtagtgaccgtcaacttcctgggcacgcgccaactcaccgaggcgctgatcccgaagatggtggccgggtcgtccatcgtgagcgtgtcctcgctcgccgccgccgggtaccgcgagcacctgcggcaggcggcgccgctgctggacaccgccaccatgcgggagggcatcgactggtgcacaagccatcccgaagagctgggcaccggctatcaactgtccaaggaagccctgattctctacaccatgcgcagcgtcaccccgctgggtgctcgtggtatccgcatcaactgcaccggccccggggtgaccgagacgccgatcttggatcaactgcgcaccgcctacgggcagggcttcctggacgacatccccaaaccgctgggccgggtcagccggcccgccgagcaagcagcggtgctgctcttcctcaatagcgatgcggccagctatatttcgggccaggtggtgtgggtcgacggcggaaacgtaggcgccgcgatcgctcgcgaactcgaggaagggcgtactccgtggccagtgtgaccgacttccgccgggccgcccgcgacgtcagcaactggggccgctggggcgatgacgacgagctcggcacactgaacttcatcaccgaggaaaagatcgcccaggccgccagcctggtgcagcacggcaaggtgtttccgctcggcgtggacttcggctcgtcaggaccgcagggcgccttcgggtttcggcacaacccgatccacgtgatgaccgtggacggcggcgacgccgccacgctggcccagtacggacccggctgggaccgcaacccgacggcggcgcagatgggcccctacttcgtcgacaacctgttccggttcaacgacgacatgatcatcatgccgctgcaggcagccacccaatgggatgcgctgtcgcacgtctactacgacgacctgctctacaacggcgtccccgccggctcggtgaccagcctgggcgcccgccgcttgggcatcgagaaggtggacggcaagggcatcacgtcacgcggggtgctgctggatctggtgcgccatcgcggcgcggaggtcttcttggagcacggaaacccgatcaccccacaggaattggatgacgtcgtgcgcgcccagggcgtgacgatcgagcgcggcgacatcctgctcatccggaccggttggtggacaagatatttggaaacaggaaacaagaccgaaccgtattccgggctggactggcgatgcgcccagtggctgcatgaccacgaggtcgccgcggtcgcctcggacaacctgcaggtcgaagacccggtgtccggcgtcgacggggtgtttttgcccttccacctgctgactctgggcgacatggggctgatgctcggcgagtactgggacctcagcgcgctggcggccgattgcgcggccgacggcgtctacgaattccagcttgtcgcaccgccgttgaggtttgtgggggcagtgggttcgccggtgaacccgatcgcgatcaaatagagaaggcgggcgatggagattcatcgcaaaacgatgtcggtcgatggcctggtcaccagctaccttgaggcgggcgagggcgacccggtggtgttgctgcacggcggggagttcggggccagcgccgagctcggctgggaacgcaacatcgccgcactcgccgcgcgctaccgggtgttggcgcccgaccagttgggcttcggcgggtcggccaaggtcatcgacttcgtcgacggtcgcggcatgcggatccggcacgtggcccggttctgcgaactgctcggcgtcgagtcggcgcacttcgtcggcaattcgatgggcgccatcaatctgctcaccgacgccacgtcggacagcccgctgtggccggtccgcagcgccgtgatcatctgcggcggcggcgaaatccagcagaacgagcatttcgaggcgctgcagaactacgacgccacgctgcccgcgatgcgccgcatcgtcgaagcgctgttcttcgacccggcctatcccgccgacgacgactacgtgcgccgccggcacgagtccagcaccgcgccgggggcgtgggaggccatcgccgcggccaggttccggcggccgggtgccacgccgtccccgacgccgtcgagcgcccgggcctacgaacgcattggtgtgccaacgcttgtcgtggagggcggaggcgacaaactccttcccgccggctggtcggctcagatcgccaagcagatcgacggcgcgcgctcggtcgtggtggacgatgccgggcactgtccgcagatcgagcagccgtccgtggtcaaccagttgctgatggattttctggcgaccgcctgagcgtaaccaggcggcgtcacaggcagcgtcacagaacgtagtccagccgggtctccattccggcgacctggtgataggtgttgtggcagtgcatcacccaggtgccggggttgtcggcggacaggacagcggcgagtttctgcttgggcagcaccatgacggtgtccttgcgggcgcccgggctgccgtcgggcttgattacctggaatgtgtgcccgtgcaggtgaatcgggtgatacatcattgtggtgttttcgaaagagagggtgggccgctggccctcgtgcacgagcagcggattcgtcttgctgtacggctcgccgttgatcgtccagttgtactggatcatgttgccgcccagcacgatcggcaggtccagaccggcatcggggcggcccaggttgaccggcgtggtggcggtgaacatctccaccgtgcccacccgtttggtgagttcgcccggctggaactgcgggtcgggtgtgctgcccgcggcggtggacagcagggcccgccccagcgcgttcttgccttcggcgacggcgaccagtgggaagacaccgtcgcccgcggtcaccgtgacgtcgtagcgctcggccatgccgatcagcagggcatcgacctgagcgggcaccacgggatagccgtcggtgtgcgtcaccgtcatcgagtgcccggccagtgcgacccggaacgcggtgtccgaggccgtgttgatcagacgaatccgtatccgctggccgggcttggcgttgaatgtcttggggaaagccgcaattcgaccgttgaccagatagtaggggtaggcgatggcgccggcgtcgccgccgagcagctcgctgctgcccacgccgggcggagccgcggcggccgtcgtcggggtggtcgacgtggtctcggtcgtcgtgaccggggatgtctcggtcgtggtggggttggtcgacgtcgtcgtcgtctcgggcgggttccgtggcggcttgttcggattgctcaattcgccgtacaactgggccgggctcttgccgacgccgtcggtccagtcgtcgagcacgacgatccactcggcgtcgtagtcggcctcggccgggtcgtcgacgatgaccggcagataaagacccgtgtcctcgtccaggccggtgtgcggatgtgcccagtaggtaccgggattgggcaccgagaaccggtaggtgaagtcgtgtccggccgcgatgttgggggtggcgggctcggcgccgtccatgtcgttgcgcagcgagatgccgtgccaatgcaccgatgtcggatggtcaagccggttcgccaccgtcaccgcgacctcgtcgccgatggcggcgcggatcaccggcccggggatggagtcgccgaaggccagcgtgcgcacgacgggtccgcccaaatcgatctgcaccggttgcggtgtcaggtgcgcggttacggtgcggccgctgtgcggccgggcggcctcggccgtggcgatggcggcggccatccgcgtgttgcgcgacgggtccggcttggactgaccgcagcccgcgagcgccaatccgccggcgataccggcggccatgaaaccgcgcctgctgagctgccttcgttccgacggggtatcaccggccggcggcacaggcattggtcgctccccgtcttcgtcgagtgggcctcgggcgccctaataccgtgctcgtgtgtcggccggaatgcaagcgccgtcatcgattccggccgtgtcgcacgggtcgggtccgaccgatcggcggccgcattcccggccacccttaaatcagttgcttgacttaacaccgttgccgccgattaactcgtcgtgtggtcaacgaactggctggcaaggttgccatcgtcaccggcggggcgtccggcatcggtcgcggaatcgtggaacgttttgtggccgaaggggcgcgggtcgtcatcgccgacatcgagaccgagcggggagagcggctggccgccgagctgggcggtgaggccgtgttccgccgcaccgacgtctccgacatcgaacaggtcggggctctggtcgcagcggccgtcgagaaattcggcggcctgcacgtgatggtgaacaacgccggaatctccagcccgttgcgccggctgctcgacgacgacctcgccgacttccaccgggtgatgggcgtcaatgtgctgggcgtgatggccggtacccgagacgcggcgcgccacatggccgacaacggcggcgggacgatcatcaacctgacctcgatcggcgggatccaggccggcgggggagtgatgacctaccgcgcctccaaggcagcggtcatccagttcaccaaggccgcggcaattgagctggcgcgctatgacattcgcgtcaacgccatcgcgcccggcaacataccgacgccgattctcgggaagtcggcgggcgacatggaccccgagcagcgggagcggttcgaggcgcggatccgcgagggaatgcgcgaggaccggccgctcaagcgcgagggcacacccgacgacgtcgcggaggcggcgctgtatttcgccaccgaccgctcgcgctacgtcaccgggacggtgctgccggtggacggcgggacctcggccggcaaggcgatgcgctcgaagcggcagggatgacacccgccgaaattttaaatcaatcgcttgacttaaaggcgcgggcgcggttgactggcgcaatgaccaccatcggacggcccgtgcgcaccgagcgggccagctccacccaggaggcgatcctggtggccgccgagcggctctatgccgagcacggcatgttcgccgtctccaatcgacaggtcagcgaggccgccggacagggcaacaacgccgcggtcggttaccacttcggcaccaaggccgatttggtgcgcgccatcgagcacaagcaccgcgggcccgtcgagcagctgcgcgagcagatggtcgccgagctgctggagtccggcgccgggggcggccgggacgccgaattgcgtagctgggtggcctgttcggtgcgccccctcaccgaccacctcgaggagctgggaaatccgacctggtatgcgcggttcgcggcgcaggcgatgaccgatcccgcctactacaacatcatcgtcaagggcgcgctcagctcgccgtcgctggtgcaggtcgtcgagggcatcaaccgctgcctgcccgacctgccggccgaggtgcacttcgaacgcaacatcatggctcgaaacctgttgatgcacacctgcgccgaccgtgaacgtgcgctcgccgcgggcacgtcgacctcccatcgttcctggcgggccgcggcatccggcctcatcgacgcgatcgtgggcctgtggctggcgcccgtgacgccgtacgagtgaaggactgggcagatgaaagtgaccgtcgaccaagacctttgcgcatcgtcggggaactgcgtgatgaatgcccccgaggtgttcgaccagcgcgacgacgacggcgtcgtcgtcctgctcaacccccatcccacggccgagcaggcgcaaggcgcgcggcgcgcggcggcggcttgccccgccctggccatccgcgttgaagaatgacgacacggcgaggaacaacaccatgtcagacaccctgacgagcaccgcgaccgagcagaccgccgacattccggactacccgatgccgcggcaggccggctgcccgttcgcgccgccaccggacgtcatggcgctggcccacgacaagccgttgtcgcgggtgcggatctgggacggcagcacaccgtggctcatcacaggctatgagcaagtgcgcgaactgttttcggactcgcgggtcagcgtcgacgaccggctgcccggcttcccgcactggaacgcgggcatgctgtccacggtgcacaagcgtccgcggtcggtcttcaccgccgacggcgaagaacacacccggttccggcgcatgctgtcaaaacccttcacgttcaagcgtgtcgagggtttgcgcccgaccatccagcagatcaccgacgagcacatcgacgcgatactggccggaccgaaaccggccgacatcgtcagcgcgctggccctgccggtgccctcgctggtgatcagccagctgctcggggtcccctacgaggacgccgacatgttccagcaccacgccaacgtcggcctcgcgcgctacgccaccggtgaggacaccgtcaaaggcgcgatgagcctcaacaaatacctcgcccagctggtcgaggccaagatggagaaccccgccgaggacgcggtgtccgatctggccgagcgggtcaaggccggggagctcagcgtgaaggaggccgcgcagctgggcaccggcctgctgatcgccgggcacgaaaccacctcgaacatgatcggtctcggcgtgctcgccctgctggaaaaccccgaccagctggccgtcatccgggacgccgaagaccccaaggtgatcgccagcgcagtcgaggaattgctgcgctacctcagcatcattcagaacggccagcgccgcgtcgcgctcgaagacatccacatcgccggggagaccatccgggccggtgaggggatcatcatcgacctggccccggcgaactgggatgcgcgcgtcttccccgaacccgaccggctctacctgcatcgctccggcgccgaccgcaacgtcgcattcggctacggccgccatcaatgcgtgggccagcagctggcgcgcgccgagctgcagatcgtgttccactccctggtacgccgcattcccacactgcaacttgcgattccgatcgaggaggtcccgttcaaggacgaccgcctcgcctacggcgtctacgaactcccggtgacctggtagcccacgaaagattgcggatccgaatggagggtcaatgatgacgactcaaacaagccccgtttccctgtacccgcccggaggatacggcgcccccaagaatcggcgcggtcacgccgtaggcagcgatgtcggcctgccggagggcacggtggtcttctcggcggacaaccacatctcgctggccgatgacatcttctaccaacgctttccggacgacctgaaggacaaggcgccgcggatctggtacgaggacggcgcctaccaggtcgggcgcaagggacagtctttcctgcccggcgacttcagcgccgtgctgatgcagtacgacgacctccccggtgcggcgagcaccaacatcgaggcgcggattcaggagttgcacgaggacggggtggaaaaggaactggccttccccaacgcggtgctggcgctgttccactaccccgacaagacacttcgcgagctcgccttccgcatctacaacgaatacatcgccgagctgcaggagcgctcgaacgggcacttctacggcgccgggctgatcaactggtgggacccgcagggcaccagaaagaccctggacgagctgaaagcattggggctcaagactttcctgatgccgctcaatcccggcaaggacgacgacggcaacatgatcgactactctagcaccgccatgagaccggtctgggacgagatcgaggccgcgggcctgcccgtcacgcaccacatcggggaaacgccgccgaagagcccgaccgagttcaacagcgtcgtcgtcgggatgatgatcaacatcgacggattccgggagacgttctccaaatacatcttcggcggcatcctcgacgatcaccccgggctgcggatcggctggttcgagggcggcatctcctgggtgccgtgggcgctgcaggacgccgagcacctggtcgcgtcctaccagcacatgttcaaccggccgctgcagcacgacgtgcgctactactgggacacccacatgagcgcctcgttcatggtcgacccgctcggcctgcggctgatcgaccagatcggggtggacaaggtgatgtggtccagcgactacccgcacaacgagagcacctacggctattccgagaagtcgctgaaggccgtcgtcgacgccgtcgggccggcgaacgcggcgcagatcgtcagcggcaatgtgacgaaattcctgggtttgtagtgacgacactcgcgcatctggacaccaaaaccggtgaagggctggtgattccggagacaccggacttgacccggctgcgccgcgacaccggaacccggctccgggcggcgatggccgagcgcggcgtcgacgcgatgatcctgctcggcaacaacgccgtcgtctatgccaccggcgccagttggccactcggcgacgccgggctgtcctatgtcgagcgcccggtggccgtggtgctcgccgacgacgaatggccgcacctgttcctgccgttccgcgagggcgccgcacacgagtcggacctgcccgccgaccatctgcacgggccggtctatctcgaattcgacgaaggcgtcgcggctttcgcgcgcacggtcgccgacctgattccggccaacgccgtgatcgcggtcgacgaatgcaccggcgcaatgtcccgcgcggccgcgacgctgttcccccgcggcgcccccgtcgacgcggcggccatcgtcggcgccgccaaggcggtcaagacaccggacgagttgtcgtgcatccgcaccgcgatccggatcaccgacgaggcgatggtcgaggtacagaagcggctggcccccggtatccgccaaatcgacttgtcggcaagctttttgcggcgcgccttcgagctgggcgccacggccagcatgctggaaccgatctggcaggtgatgccgccgagcaaggccgagggggtatggaccacgcacggcgacctggcgctgccgctgctgtccaccgcgcgcgagctcgacgaaggcgacgtgctgtggaccgacgtcagcatcacctaccagggctactgctcggacttcggccgcacctggatcgtcgggcgggacccgtcgccgcgccaacaggcccagttcgacaagtggttcgaaatcatgaccgcggttctggatgtcgccaaggccggcgccaccgcggccgatctgggccgggccgcgatcggggccaacggcggtgcgaagccgtggctgccgcacttctacctgggccacggcatcggcgtcaacgccgccgaaatgcccatgatcggaaccgatctcggccaggagttcgacgagaacttcgtcctgcaagccgggatggtgctggtgctggagccggtggtgtgggaggacggcaccggcggctaccgcagcgaagaggttctggtgatcaccgaggagggctggatccgcttgaccgactacccctatgacccgtatggccgtcatgtcagttgaagtctgccccgacgagcgcacgctgcgctcggggcgccgccggcgggcgttggaccagatggccgcccacgacctcgacgtgctggtgctcggtcggcaggccaacgttcgctacgtctccggggcgccgcaactgtgggtcgcgggcacccggccgttcggcccgacctgcgtgctggtgcgcgagaccggcgcggttcacctgctcagcacctgggacgagggcgtgcccgaggacatcccgcacgaaaacctctacggcatctcgtggaacccggccaacaccgtggcggcgctgcgccgcatcgacggcagccaaaccgcccggcgcgtcggaaccgacgcactctcaccggttttcgcgcagctgctgcccaccgtgttccccaacgcgcaactggtcgacggagaactggccatgcgggccgcccgccgcgtcaagaccgccgaggagatcgtggcgctgcgggaatccatcgcggtcgccgagtcggcgctggcggccgcggtctcggagttgcgccccggggtcagcgagcaggcgctggccggcgtcctgctggaggcctccgcggcgggcggggtgagcaccccgtcgaatcaggatgtggcgtgggcgacctcgcgcagccatccgtggcggcgcgccgacggtgacggtcgtatccaggacggcgacctggtggcattctccgccggcgtgctggccggcggctacgtcggggaagtgggacgcacctggccggccgacaagaagcacgcccccagcggcgccgcggccctgcaccggcgctgggacgccttgtgggacaagctgatcgctgcctgccatccgggcgtgcgggcggacgagctgatgacggcctaccgggccgcgggggagccggcaccgccgatgccggtggcccgcggactgggtatgggtttcgacccgccggtggtctcccagcacctgcccgcgaccgccgccggcgaacggctggagccggggatggtgctcgccgtgacgggatacgtgtgggaggaaggagtcggcgcggtgttcggccgggaagcggtcctgatcaccgccgacggacccgaagtgctcaccgcgagcccgttctggcagccctgaccatgccccgccccggcgaagcgaacgaagtagtgacgcaacccccgctggccggctatacggtgatcgatctgtccaccggcatcgccggagcctactgcaccaagctcctggccgacggcggcgccgtggtggtcaaagtcgaaccgccgcaaggcgatccgctgcgcacctggtcggcctccggtgcccccgtcccggccggtggtgacggcgccctgttcagcttcctggccggcgccaaacacagcgtcgtcgccgaccccgccaacgaggacgacaccgcgctggtgcaccggttactggccgcggcggacgcggtggtctggtcgggcgggtccacggtggccgagcaccacgacttcacgccgcgtgcgatccaggcccgccacccccatctcaccgtcacctcgatcaccccgttcgggctggaaggcccctggcgggaccgggcggccaccgagttcaccctgcaggcctggtcgggaggaatcatcggcctcgggcgcggcgagcagcaccgcccgcccgtcttcgtcggcggtcaggtcggcgaatatctggccggggcctatgccagcgcggccaccctggcgtcgcgctggcgccgaatccacggcgggccaggagaattgctggacctgtccatgctggagacacagatcctgtgcctcacctactacccggtcacctacttcgaggtgctcggccggccctggcgtgacacccggcggccgaccgtgccgggcgtggcgcaggccaaggacggcctggtggacgtcggctgcggcaccgcccagcagtggttcgacctgtgcgccatggtgggtcacccggagtggatcgacgaggactcgccgctgtcgatcaccgagctggccaacatctacgccgacgagatcttcgcgtggatggcccgcactcccgtcgaagaaatccgggaactggcaacggccttccgcatcccgtacgccccggtggccaacggggcgaatgtcacgtcgttcgatcagttccgtgagcgcgggtccttcgtgcgcaatccgcgcgacggcttcctgcagccgggacacccctaccggatgcacccggcgcagctgcgcgcgccgcatcctgcgccgcgcctcggtgagcacaccgagggctaccgcggcgcggaactgacgccacggcccgcacccgacggaggtcgagcagcgttgccgttcaacggacttcgggtgctggacctcaccacattctgggcgggcccctgctgcacccactttatggccatgctcggcgccgaggtcatccacgtggagtccacccgccgtcccgacggcacccggctgatcgccggggtgcccgtcagcgaggaccggtggtgggagaagtcccccatcttcgaggccctgaacaccaacaagaagggcctgaccctggacctgcagagcccacgcggccgggacgtgttgcggcggctcatcgccacctgcgacgtgatcgtggagaacttcaccccgcgggtgctggatgcgatcggactggatttcgccaccgtgcaatcgattcgcgccgacgcggtcatggtgcggatgcccggcttcgggctcaccgggccgtggcgggacaacccggcattcgcctacgtcatcgaatccgcgtccgggttgagttggctcaccggctacccggatcgcaccccctatgacccgtactcgatcggcgacccgtgcgcgggggtgcacgccctcaacgcgatactgctggcgctcgagcaccggcgccgcaccggcgagggggtgttcgtcgaggcggcgatggtcgatgccgcgctgagcatcgccgccgagcaggtcatcgagtactcggcctacggcgcgctgctcgagcgggccggcaaccgggggcccaccgccgccccgcagaacctctacctcagcgccgacgtcgacgaattcggccggctcgacagctgggtcgccatcgccgtggccaccgacgaccagtggcagcgattgtgccgcgcactcggatccccctcgtgggcaatggatcccgagctgtcggccgcttccggccggcgtacgcatcaggatttcatcgacaagcagctcgcggcgtggtgcgagtgccgcggccgcgacgacatcgtcgccaccctctgggacgccggggtgccggtggccaaggtcatgcaaccccaccggcaatccgagctggaacagctgacgttccggggctttttcgaagaggtcgaccacccggtcaacggcccggctaggctcagcaccgtgccgatgagatcctccgccggccccgatcggttccacaccgcgcccgcgccgctgctcgggcagcacaaccaggaactgctgtccgggctgggcttgtccgacgcggacatcgcgacgctgcgggccgaaggtgtcatcggcagcgcgccggccatacacccggcgggctgaccggcgatggccatcgatccctcggacatcctgctcaccgaccgggtcgcggtggtgaccggggcgggggcgggcatcggccgcggcatcgccgccgggctggccgcattcggcgcgcgggtggcgatctgggagcgcgacgcgcaaacctgcacgcgggcagccgaatccatcggaggactgggcatcgtcaccgacgtgcgggacagcggccaggtcgacgccgcgctgcagcgcaccatcaccgaactgggcacgcccgccatcctggtgaacaatgccggcggggtgttctcctcgccgctgctggaaaccagcgagaacggctgggatgcgctctaccgcgccaatcttcggcacgtgctgctgtgcacccagcggatcgcccggcagctggtgtcggtgggcgccggcggcagcatcatctcgctgacctccatcgaaggcgtgcgcgcggcaccgggctatgccgcctacgcggcggccaaggccggcgtcatcaactacaccaagaccgcggcgctggaactggcgccgcacggcatccgggtcaacgcgatcgcgcccgacatcacgctcaccgaagggctggaacagctaggcggtgaggccgccaccaccgcgatggggaacatcgttccgctgggccgtcccggccacgtcgacgaaatcgccagtgccgcagtctttttggcttccgacatgtcggggtacctgacggggcagacgctgcacgtcgacggcggcacccaggcctccagcgggtggtatcacgatccgcggaccggcgactaccgactgggcccggccggttagctcaccgacgctgccgcaacagccccgagggcccggccccatttatctagtgcgtccagccctcggcggcctgctcgtcgaaggtccggtcgatgcgttcgaacctgcggcggatcgactcccgggcggccgcgtgcggcaggatgtagagccgattggccaggatcgcgtcggcggtgagccgcgcgacgtcgtcggcgctgacgctctcgtcctgggtgggcagcggcccgaaggccccctccggcgtcgccgacatcccatagtcggcgccgcgaatccgttccgagttggagaccagcttggtctccaccaccatcgggcacaacaccgatacgccgatgccgttgggcttgacttcgcgcgccaacgtttcggcgagcccgacgaccccgtatttggcaacgccgtaggtgccgaggccggcgttgggcaccagaccggcgaaggaagcggtgaacgcgatgtgcccgccggtgccctgctcgagcagcctgggcaggaacgcctcgacggcatggatggagccccacaggtcgatgtcgatcacccagcgccagtcgtcatggttcatctgggccagcgggcccgcgacgacgatgccggcgttgctgaagacgacgtcgacgccgcccagcagccggaaggcctcatcggcgagacggaccatttcgtcgagatgccggacatcgcacaccacgccgtgcgcgtcgaacccctggccgcgcagcccgttgaccgcctgttccagcgccggctggtcgacgtcggagagcaccagacgcgccccccggcgggcgaattcggtggcggtggccaatccgatgccgctggcgccgccggtgaccaccgccgcgcggccgtcgaaaccagacaggaatccgtccatgggacggaactctatttcaggcagctacccgcatcgatgggcagggtcacaccggtgatgtagcgggcttcgtccgaggcgaagaacagcaccgcgttgctgatgtcgatcggctcgacccacgggatgggcagcgtgtggaacatctggcagatcggcgccatgtcgtcgggacccgggttctccagatccggacggaacatcttgaaggtgccctcgttgtgcagcatcggggtcttgacgtgcgtcgggtgtaccgaattgacgcgaatcatgtgctgtcccaaatcgactccgaaggcgcgcatcagcccgaccacgccgtgcttggccgcgacgtagtggccggtgtgcgggtaggccttgagcccgccgaccgagctggtcaggatgatggatccgccgcggccgccggcgatcatatgcggcacaccggctttcacggttttccacaccccggccaggttgatgtcgatcatctcggtccagtcttcttcgctggtcttgtccaaagtgtcgccgccgttgccgattccggcgttggccacgatgatgtccagccggcccagctgctcgacgccgctgtcgaccgcggctttgagcgcgtcgtagtcgcgcacgtcgacctcggcggtgacgattctgcggttgtgccccttgaccagatcggcggtctcggccaggtcctcgggcgtggaggccgggatggcggtgtccaccacgcccgcccggatgggcttgcagatgtcgacggcgatgatgtcggcgccctcctgggccaaccgcaccgcgtggctgcggccctgaccgcgtgccgccccggtgacgaaagcgactttgccctcaacacgtccggtcatggctacctcaactcctgacttgatcggatcggcgcgcctcagcggagaacacacacgcttccccggaccgcgggtcttgccgactttgaactctgtcattcagccaacacgggtgtcaacgacgaatccgtttcggctattcgtgattctagatattagagaatctcattctcaccggcaaacagcgtgcggtatttgctcaacccggggagggtgcgggacgggtccggtcgggaagctaggcgacgaagccgcgcgagcagaagtcccacacctcttcggcggtgatggggtgggtggtcgcgtcgtcgggaccgccgctggattgcgcgatgaacatgaccgtttgcatggtcattgcggccacccgcttcgggttgatggtggtgcgcagcttgccggcctcgccggccgcctccatcagctccgtcagcaacgcgagcaagggcgcatgcgcgaccttgacctcggcggggtgtgtcaccagcaaacgcggtgcgaagtcggtgaacagtggccgcttggcggtcgggtccgggcgggacgcctcgtacagcagctgaacggcgacttggagccgctccagcggatcggtgtggctttcggtggcggcccggatctggtcggcggatcggctcagcgcgtcctcgaagagcgccagcaacagctcgtgcttgccgtcgaactgcaggtagaagctgcgcagcgactggcgggagcggtccaccacctcctgcacggtaaagtcggtgctgcccttttcgatgatgatggcctgggccgcgtcgaggaagcgctgaacgcgttgcgccgcacgcaatttcgccgttttgatggagcgctcgacggcgcgctgcttccaggccggctcttcgctcggattggtcacggccgactcgggtgattgccgcgaggggagaacatgattggactctaccggagaacgccgtgacatcgctgcgctcgaccccctcacggatcacgtgtcggagattgtaactttcttacggcgagaatactattctcttagacgtgtgtagggaagcgtaatcgcaaagagcgaaccgtgccgtcggcggaaagcatgatctaccgacggtgcgcgaggccagttcgggaagccggggaagtgctgtgcaactgacgtttgacgccgacgtggaggcgttccgggccgaattcgtcgccttcctcgatgcgcatttgcccgccgaggccgaggcgctggagcggccgcggtccagctcacacgtaccggagtgggcgcgccgctggcaacgactgctgttcgacagcggctggttgctgcccggcaatccgcccgagttcggcggccgcaacgcgacgttgctgcagcagtacgtgtacttcgaggagctggggcggcggcgcatctatcagagcttcaatccgcagggcgtcgggatcatcgcggcgtcgctgttgagcttcggcacccccgaacaaaagcagcgctgggcggtgccgattctgcgcgcggagatgaccgcctcgctgggcatgagcgaaccgggcgcgggttcggacctggcgtcactgaaaacccgcgccgtgctcgacggcgaccgcttcgtggtcaacggccagaaggtgtggacctccggcgcccacgacgccgacgtgctgctgacatttgtgcgcaccgatccgaatgcgcccaagcacaaggggatcagcgtgctgctgatcccgaccgacactccgggcgtggtgcgccgcccgttcgcgtcgatgtgcgatatcgacgaaatcgatttcaacgaggtgttcttcaccgacgcgcgggtgccggcggagaacctggtgggcgagctcaacgagggctggcgggtggccaccggttcgctgggacacgaacgcgtcatgctgtggatgggttatgtcgatctgctgcacgaattgagcgccgacttccgtccggccgatgcgctgcagcgggaccgctacgccaccctggtgatggacgcgcacgccctgcggttgctgggatcggcggcgctggccgccgccgcccgcggcgaagaggacgtgcccgcccagtccgtgctcaagctgctgggttccgaggcgctgcaacgcgcgtccgaggacgcgctggaggcggcggggtccgccgggctggtgcgccgggcggtgaccgcgcaggtcgcgccgctgaatctggacagcgactaccgcagctggttcgaccgctacgcgcgcaccttcgccgccaccatcgccggtggcacgtcggagatccagcgcaatatcatcgccgaacgcgtcctcgggctgccgcgcaattaagctgcgcgtcagcggttttgggcatccatgcgggcgtagtagctgatcgccaccagccccgcaaggatcgcgacggcccctaacacgatccccgtcatcgcggttcggggattgctcgcttcgccgcgggcgactcgccgccgggcgatgtcgcccgtcaccaccgccgcgatgccgaagggcacccccagcagcagccagcaggtgacgagcccgaccagacccagcagcaccgacgcgacgccgaactcgttacgcggcggctgcgggtcactcatcgcctctcaccttcgcggttccgcgcatctgcgaagcatctcacggccggccaccgtgagggggtgggctgggtgctagagctgggcgagccgcggcgccgatccggtcgtcaccagcgtctttcccgcttggcgggtcaattcccgggcgctgcccagcaagccgtccaggatcagcgagcgcttgatgtggtggtgcagcgggtgctcggcggtgaacccgataccgcccagcacctgctggcagtggcgtgcggtggtcagcgccgcctgcccggccgcggccttggccagcagggcggccaggcccgggtcctcgtcgcattccgcggcggcctgcagggtggcctcggcgccctcgaccgctaccagggcctccgccagccgatgccggatcgcctggaatgagctgatgtgccgaccgaactgcacgcggtcgacggcgtgccggcgggccagcgtgagcatggcccggctggtgccgaccagccaccagcccagcgcccgccaccccgcgtgcagcgcggcgtccggcaatggatcgccctgcggcacacggtgtatcggcagcagctcgtcgatcgccgagtcgcagctgtcgcggcgctcccacagcacccaggacccgccggtgaacggcaacgccagggtgccctcgggggcttcgccggccgcgcacagcagcacgtcgttgagcagcggggcgtgcgcccccgtctcgccgagcagtgtgaacaccaaagggattgcgatgtccggcatttcgtcgagcatgtcgcgccagcccacatcggtcagcgcggcgtccagcttcgctcccgaggcggcgctcatcgtggtgcgcagcgagtcggtcagcaggcgcagcgactcggcgtcagccgaaggtgccacggttcactccttcccgagatcgagcagccggcgggcgatgatgttgcgctggatctcggcggtaccgccgtagatggtggccgcgcgcgagtacaggtattccgagcgccacggcgtgttttcgagctccagggtgcccggcaacaggtcgcgcacggtgtcgtagagccgctgctcggcggtggccagcagcaccttgtcgatcgaggtgtcgggccccagccgggccccgtcaagcatccggtgctgggtggcgcgcgaccggcagcgcaacgtgtgcagcgccaaataggctgcgcccagggaggattcgtcgggctccccggccgccgagacctcggcgatcagatcgtcgaaacgcgagtagaggtaggcgatgcgctgccagaagcaggaggaccgttcatacggcagcagatccatggccaggcgccagccgtcgccgggccggccgagcatgcggctcgacggaatcgccacgtcgtcgtagtacacctcgcagaattcgtcgacgccgtgcatggtgcgcagcggccggatggtgatacccggcgtgtccaggtcgacgaagaaggcggtgatcccgtcgtagccgggcgcggtgcgggtcagcagcacgcaccgggtggagaactgcgcgaagctggtccagaccttctgcccgttgacgatccagtggtcgccgtcctgggtcgcgcgggtagtcagcgacgccaggtcgctgcccgaccccggctcggaaaagccttgacaccagtgctcttcgccgcgcagcagccgcggcaccatctccgcggccagttcggcgggggcgtagtcgatcatggtgggggccagcacctcgagcatcgagtagggtccgggttcggccagccggcggcccaccacttcctcgccgacgaccgcccgcagcaccgcgggtccgcccaggccaccgacttcggccggccaccgacttcggccggccacccgtaccgcatccagtcggcgtcgtagagagcgcggctgacccgggcgaactgcttcatgtggccctgcagggaatggtcgggcccgggggtcagatcgttgtcgtcgagccacgcgcgcaggtcggcccggaactgctcgacattcacactgtcgatgggtcggctccttaggtcgctgcctgggccgcggagtcgccggccggacgcccgatggcgtgcgggcgcccggagtcgtgcacaccgctgcggcggatgaaggtcatggcgcgggtcttgaggcgccagccgtcgggggtccgcacgtaggtgtcgcggtagtagccgatccgcatgtcgtgcgtggcgtgatcgatgaagcacaacggctgggtgccgctcgcctggtcgccgtcgaggtcgaccaccgcggttccggtgagaaacaagccctttggcgccgccgccaccaattcggggaatcggttcaggctgtacgtctcgccgaaggcgctgtaggttccgtccggcgtgaagacggcgaccagcccgtcgatgtcttcctgggtgatggtgaccgcgtagcgcgcgagcagctgctggatctcgaccaggtcgtcagttctggttgtggacatagaccttgccgcctttcatgacgaagctgacgtgctgggttaccgtgatgtcctccaacggatttcccggaacggcgatgacgtcggcgaggtagccctcggccagccggccgcggtcgctggagttgatcaactcggccgcggtgacggtggcggcccgcagcaccgccaccggcggcagcccccactcgacgagcgtgacgagttcatcggcgttgcggccgtgcgggattgcgggcgcgtcggtgccgacggcgatcttcaccccggcccggtgcgcggccaggatcgaggtgcgcgacttcgggaacatctgggcggccttggcctgcagctcgggcggggcgtgcgagacgtccatcccctcggccaggcgacgggtgctcaccaggaaggtgccgtgctcgaccatgctggcgatcgcctcgtcgtcgatcagaaaaccgtgctcgatgcagtcgatgccggcggcgaccgcgtgcttgaccgcgtcggcgccgtgggtgtgggcggcgacgcgcatcccgcgccgatgcgcctcatcgacgatcgcgcgcagctcctcgtccgaatagtgctgtgcgccaggtggtcccgtcaatgacatgacgccacccgagtggcacaccttgatcagttcggcgccgtgcttgatctggtagcgcaccgccttgcggatctcgtcgatgccgttggcgatgccttcctcgacggtgagttccagggcgtgcggcgcgaacgcggcgaacatcgtcgggtccaggtggccgcccgtcggggtgatggcgtgcccggccggcaccacccggggcccgtcgatccagcccgcgtcgatggccttggccagcgccacgtccagtagatatccgccggtcttgacgaacaggcccaggttgcgcaccgtggtgaacccggcgcgcagcgtgcgccgggcattgccgaccgcgcgcagcacccgggtcggcgggtcgtcctgcacctgagacagaccgggtttctccccgcgcccgcccatcagcaggttgacctccatgtccatcaacccgggcaacaggatcgcctcgcccaggtcgatcacgttgtcgtccgcgcccgtcgggcccgagtccccgactccgacgatccggtccccgtcgacccgcagaatcccgggccgaacgatctcgccggcgtcgacgtcgaacagcccggcggccttgatcgtctgcaacgtcagatcaccggctccctgatcagctccacccacgcggccccgctgtcggggacgcggggctgcttccacgcctcgatcggaaacgacaccatgaccaacgactgcatcatgtgcatgagcgtcttcgcgtcctcgggtaggtcgtcgagcgggtactggtcacagtaggcgatcacgtcgttgaggcgcggaaaggccgcgtcgtagaacgcctgcatctcgctcatgctcgaggccagccgcttggcatagcgctcgggctcggtggcgaggtcccactccaaatacggctctaaatcggcgaattcagcgggcagcgacgtggccattgttctggtactccttcacgtagtcgccggtcgtcttgtgcaggtgacggatcaggacttcctggtcgcacagcaggaactccttgacggcccgggtgccgatcatggtctgggtcgcttccagggtgttggcgtcctgcagcgcgtactccttgaacgtcaccgcggccagctcctgggccaggcgttcccgcgcgttgcgcggcggcacgaaatacagcgtggactcgaagatgtgccggtccaccgcggtgggccagtagtggtaggtcaaaaaccagccgggctcccagatcagcagcatgaagttcgggtagaacagccacgagtcgatgccccactgcggcacccgcttgacgttgacacccggtggcaggtccagcttttcgatgatctccggcttgtcccacggaccgaacaacccgctgcgcaacacctggtccatcggcttgaccatggacatgtccgggggcggtgcctgaccaccccaggtcgactgcaggctgtgcggcccggccagctcgtagtgcagtgcctcgtagccgaacttctggatcttggcggcttcctccttggtgtactgcccctggtgcaggatcggcgcgtggtagaactcgacgaacgcgtcgatgaacagcttccagttgctgcccacctcggcccggtaggaatacgtctcggtcatctccccgaaggggtagccctcgatgctcttggccagcggcccgaggtagtcggtgagcggggccgcgttgtcgtcgaagttgatgaagatgaagccttcccacacctcgcaacgcaccggcgccaggccgtagttgctcttgtcgaggtcgaagaactcctcctcctgttgcaccaaggtcaggtcgccgtccaggctgtagcgccaggcgtggtatttgcaggtgaactggcggcaggcgccggacgtctcctcgttgggaaagtcgttccacaccaacttgtttccgcgatgacggcagacgttgtggtacgccttgaccgacccgtccttggtcttgacgatgatcaccgaggtacccttgccggccgacgggagctcccgggtgaagtagctgccggtgcggggcagtcgattgacgcggccgacgttgagccaggtcttcttgaagatcgcctcgcgttcggcttcgaagaaggccgggtcgatcgagtcggtgtaatcgactgggccggttccgagttcggggtagttttctgtccagctgcctgcggctggcttggggaagtgaggcaccgttgttactcctctttctcagtgctgttcggcatgttcgagctggatgccaaaagtgttgaaggccatggccagcagggtgtagcagcccaccgtgaagacgtagtccatgcgttgccggtcgtcgaggcgctcgcccagcgccgcccaggtccggtcggacagttccgatttttcgtcgagctcgtcgaccccggcgagcaccgcgtggtcgaacgcgtcgaatgggccggcgccgtcgccggcaaaacagcgcaccgccgcgatctgctcgtccgtgattccctcgtccttggccatgctgacgtgatgggaccactcgtaggcgcactgccggcgatgggccacccgcaggatggccagttcgcgcacccgcggcggcagcgtggaagccgtcagcaggtggacgttgaatcgaagaaacgccttggccagcgccgggtggtgggccagcgtggacagcgcgttgttggtgtcggctccgcgcatcgccgcgagcgcctgccgggtcgcctcgtcccactgctcggcggggagcggctgcaagcgcattagcagtgtcctctcggtggaagagaatcagattctcatttgcaactaacagactggcacgaaacgtgcgctcggtcaatgccggcgtgcggggcggccccgcggcgctcggcgtgcgcctcagcgcgtcgaccgtcgcgggccagaaatttggttcgcggtcaagggcctggtcaggcggcggcgcgcggccggggcaaccgctggatgttgattctcacctgacgagaagatagttttcattttagtgatcttggcacgggacagcgattcgccgcggccgtaatcgatccggcggatccaacggaagggcaacggccatgaacaaagaggacatgatcctgatcagcgtcgacgaccacaccgtcgagccgcccgacatgttcaagaaccatctgccgaagaagtatctggacgacgcgccgcggctggtgcacaacccggacggctcggacgggtggaagttccgcgacaccgtcatccccaacgtggcgctcaatgcggtcgccggccggccgaaggaggagtacggcatcgagccgaccgggctcgacgagatccggccgggttgctacaacgtcgacgagcgcgtcaaggacatgaatgccggcggcatcctggcctcgatctgcttcccgtcgttccccggcttcgccgggcggctgttcgccaccgaggacaacgacttctcgatcgcgctggtgcaggcctacaacgactggcacatcgacgagtggtgtggggcctacccggcgcgcttcatcccgatggcgatcccggtgatctgggatgccgaggagtgcgccaaggaggtgcgccgggtgtccaagaagggcgtgcacgcgctgaccttcaccgagaacccggccgcgatgggatatcccagcttccacgacgagtactggaacccgctgtggaaagcgttggtggacaccaacaccgtgatgaacgtgcacatcggttcctcggggcggttggccatcaccgcgcccgatgcgccgatggacgtgatgatcacgctgcagccgatgaacatcgtgcaggccgccgctgacctgttgtggtcgcggccgatcaaggagttcccggacctcaagatcgcgctctccgagggcgggacgggttggattccctacttcctggagcgcgcggaccggaccttcgagatgcactccgcttggacgcaccaggacttcaagggcaagctgcccagcgaggttttccgcgagcactttttgacctgcttcatcagcgacaaggtcggtgtggcgctgcgcaacgagatcgggatcgacaacatctgctgggaggccgactacccgcacagcgactcgatgtggcccggcgcccccgaggagctgtgggatgtgttgtccatcaacaacgttcccgacgacgagatcaacaagatgacctaccagaacgccatgcggtggtattcgttcgacccgttcacccacatttcgcgggaacaggccaccgtcggtgcgctgcgcaaggccgccgaggggcacgacgtgtccatcaaggcgcagggccacgacaaggacagccggggcggctcgtcgttcgcggagttcgcggccaacgcgaaagcgctcaccggcaacaaggactgagcaccgtactgtcgccgagcagacgcaaaagcccccgatccatcggcgtgtcgggtgcttttgtgtctgctcgcgctcgagaaaggggcgtggcatggatttcgcgctgaccgaggaccaggagctgatccgccggtccgtcgcggagttggccgggaaattcgacgaccagtactggatggagaaggaccaggcgcacgaatttccgaccgagttctacaacgccatcgccgagggcggctggttggggatgaccattcccaccgagtacggcggtcacggcctgggcatcaccgaagccaccattctgctggaggaggtcgccaagtccggcggcgccatgaacgcggccagctcgatccacctgtccatcttcggcatgcaaccggtggtggtgcacggctccgacgaactcaaggcccgtaccctgcccgccgtcgccaccggtcaggtgcacgtctgcttcggcgtcaccgaacccggtgccggacttgacacttcacgcatcaccacgttcgccaagcgggatggggaccgttacatcgtcaacggccgcaaggtgtggatctccaaagcgatggagtccgacaagatcctgttgctgacccgcacccaggcctacgacgaggtcaccaagaagacagacgggatgacgctgttcatcaccgacctggaccgcagccgggtcgacatccgcccgatccgcaagatgggccgcaacgccgtcagctccaacgagttgttcatcgacaatctcgaggtgccggtcgaggaccgaatcggcgaggagggcaagggattccagtacatcctcgacggcctgaacccggagcggatgctgatcgcggccgaggcgctgggcatcggccgggtggcgctggacaaggcggtgaaatacggcaacgagcgtgaggtcttcggccgtcccatcggcatgaaccagggcctgcagttcccgctcgccgattcgcttgcccgcctcgatgcggccgaactgatgctgcgcaaggccacctggctctacgacaacggcaaaccctgtgggcgcgaggcgaatacggccaaatacctgtgcgccgacgccggcttcaccgcggccgaccgggcgttgcagacgcacggcggcatggggtacgccgaggagtaccacatcacccgctacttccgcgaggcccggctgatgaagatcgcgccggtcagccaggagatgatcttgaatttcctgggcgccaacgtgctgaagttgccgcgcagctactaggcccggcgtcgaacgtgtactcacggctgatttttggcgattttttcgctaccagtacacgttcggcaatgatgggacggtcgggcatgaggaatcggagtaacagttatgcgtgaaacagtcatcgtcgaggccgtgcgcaccccggtgggtaaacgcaacggcgcgctgtccggcatgcacgccgccgacctgtccgcgatcgtgctcaacgaactcgtcgaacgcacgggcatcggacccgagctcatcgacgacgtggtctggggctgcgtctcccaggtgggcgaccagtccagcaacatcggccgctacgcggtgctggccgcgggctggccggaaagcattcccgggaccaccgtcaaccgggcctgcggctccagccagcaggcgctggacttcgccgtgcaggcggtgatgtcgggtcagcaggacgtcgtggtggccggcggggtggaggtgatgagccgcgtcccgctcggtgcggcccgggcgaccggcatgccgtacggccccaaagtgcttgcccgctatgacgacttctccttcaaccagggcctgtcggcggagatgatcgccaagaagtgggggttcacgcgcacccagctcgacgagtactcagtccgctcgcacgagcgggcggccgccgcccaggacgccggcgccttcaccgaccagatcgtcccggtgttcgtcgaggacgccgagaacaaggtcgtcgccgccgacgagggcgtgcggcggggaagcagcgtggagaagctggccgcgctcaaaccggccttcgccgaggacggcgtgatccatgccgggaattcctcgcagatctccgacggtgcggccgcgctgctggtgaccaccgccgagatggccgtcgagctgggactgacgccgatcgtgcggtatgtggccggcgcggtcaccggcgccgacccggtgctgatgctcaccggcccgatcccggcgaccgagaaggtgttgaagaaggccggcgtcgcgctgtcggatgtgggcgtgttcgaggtcaacgaggcgttcgcgccggtgccgctggcctggctggccgagaccggggccgatgcggcccggacgaatccgctgggcggcgccatcgcgctggggcacccgctgggcgcgtccggggccgtgctgatgacgcgcatggcacatcacatgcgcgacaacggaattcgttacgggctgcagaccatgtgcgagggcgggggcaccgccaacgccaccctggtcgagctggtgagctgaccgcggaaaaacaccggtgggtgacccttgtcacagcggccaaactaacctactgtgtgttcactaggttggttttcccacgtcgcccggctcgaggagttgcatttgcccgtcgcacggcgctacgacacgctgctggccaagggcgaggaccgcaagcagcggattctcgacgtcgcgcagcgcctgctcacccgcaacggctggcgcaacaccaccctcgcccagatcgccggggaggccggcgtcaccccggcgggcctgctgcatcacttcgaatcgaaggagcagctgctgcacgccgtgctcgacgcccgcgacctcgacgacgacacccacgccgaccggaccggggacctgttcgaccagatcgccgcggtcgccgaccggttttaccgggcgcccgaactggtgggcaccttcacggtgctactggtggagaacatcttgcccgaggcgccgctgcacgaccgcatgctggccaggcaccgggccgcgaccgacatcgtcgccgacctgatccgccgcggccaggccgatggccgctaccgcgccgacatagaccccgccgtcaaggccgttgagattctcgccttcgtccacggaatggaaacgacatggttgctcgatccttcgataccgctgcccgaggtgttcaagcagtacgccgagacactggctcgggacttcgcgcctccgaagagggccgagacgacatgagataccggctcgacgtcgtcgccgccaccgccgtcgacgtggtgcgattcgccggcggctggatcttcgaccggtcgatggccggatgggacgtcacggtgctgctgatggacctcgccgaggaacccgacccccggccgctgcaaatcgtcggcgcccaggtactcgacctggaagaggcgctggcgtcggtgcacgcgcgtccccgtccgcaggcgctggcggccggcgccgacctgttcggctgcgacgcacgggtgcgtcagggcgtgctgcaggccctcgaccacggcgtcaccgaggtcacgctgtggggcgagacctggccgtccgaactcgacgacagcgtcggcctggtgcagcaccggctgagcatggcggcgcagacgttcaaggccaaggccctggcggccgcctcgggcgtcgacggggcgccgcaggtggccgtcgatcgcgtcgagaccttccgcagcgggttgctggcctggccgtcggtggccgccgacctggtgcccgccagctgatccggcgccgggcctggctgtgaccggcgccggccggttcccgccgggggccgcgttgacgaccaccttggcgtatggaaatgtaatgctcattcacgagaggcacgttctcactagccgagattcaaggagcaggagatgacgaacgaattctccgagttggacttcttccgcggcagcgagctcatcgagaacccgtacccctactacgaggcgctgcgccagcggtgccccgtcaccaaggaaagccaccacaacgtcaccatgatcaccggctgggacgaggcctgcgcggtgctcaacgacgccgagacgtggtcctcgtgcatctcggtcaccggcccgtttcccggctttccggtgccgctggaaggtgacgacgtcaccgagctgatcgagcggcaccgcgacgagttgccgttcagtgaccagctgcccaccctcgacccgcccacccacaccaaccaccgctccctgctgatgcggctgatcacccccaagcggctcaaggagaacgaggacgccatgtgggtgctcgccgaccaggcgctggacaccttcctggcgccggggcacggcgagttcatcaagggcttcgccggcccgttcacgctgctggtgatcgccgatctgctcggcgtgccggaggaggaccgggacaagttcgtcaagggcatccgccagcactcggggggcggggtcggcggcaccggcgaggaaacgctggcgcacagcccgctggaattcctctacggcctgttcttcgactacgtccgcgaccgccgtcggcaaccgcgcgaggacgtgctgaccggtctggccaccgcgacctatccggatggctccatcccggaggtcgaagacgtggcccgggtcgccagcaacgtcttctcggcgggccaggaaaccaccgtgcggctgttgggggcggcgctgcagacgctcggcgagcgcccggacatccaggcgcagttgcgcaaggaccgcagcctgattcccaacttcatcgaggagtcgctgcgccacgagagcccggtcaagggcgacttccggttgaaccgaaggccggtcaccgtcggcggcgtcgacctgcccgccgggaccacggtgatggtggtgcaggcggcggccaaccgggatccgcgccggttcgacgaccccgccaccttcgacccggcccgcaagaacgcccgccagcacatctccttcggccgcggcatccacagctgcccgggcgcgccgctggcgcgcgccgagacccgggtggctatcgaacggctgctcgaccgcaccaccgacatcaggatcaacgagaacatccacggcccggcgaatgaccgccgctaccaatatgttccgacctacatcctgcgcggtctgaccgaattgcacctggagttcacgctggcatgagggtttgggtagacgaccagcgctgtcgcggccacgggatgtgcctgacgctgtgtcccgaggtgttcagcctgaccgacgacggctacgccgaagcgatagatgccgatgtcccaacggaattggagtcggccgcccaagaggccatcgaatgctgtcccgagcaggcgatcagcgaaaagtaaacgcgagtaaggagattcgagtggccgacgggcgaaaaggctatgccatcctcaccgaggccatcaaagatccggagggcatgaaggcctacgcgaaggccgccggatcggcgatgagcggcgccaccgtgcttgccgtggacaccgcgcccaccgtcatcgagggcacctggcacggcgaccagaccgtcgtcctggaattcgaatcggtggacgcggcccgggcgtggtatgagtccgagggctaccagaaagccgcgaagctgcgccaggcggcggccgactgcaacgcggtcatcctcgccggcttctaacggcgcgctactcgccgacgatggagatcgcctgccgggggcattgacggacggcctcgcgcacgtcgtgttcgttctccggggtgacttcttcctggtgcacggtcagcatgtcgtcatcgccgagctcgaagatgtccgggttgatgcccatgcagacgccgttgctctcgcagagcccccaatcgacctcgatcttcttcgtcaccgtgacccccttaccgaagcaccttgacgggcacgttcttccagcccgccacgttttgcatggtcactcgtctgcagcccgcccagtcgacgtcgtagcgcggcatgaagtcgagcagccgctccagcgcgatccggctctccaggcgggccagcgcggcacccaggcagctgtggatgccgtatcccaggccgaggtgctgggcctcggtctggtcccgctcgatgtcgaaggtgtcggcgtcggtgaaggcctccgggtcgcggttggccgcggcaccgcacaggaacaccggcttgcccgccgggatcacgcccccgctgacgtgcgcctccttcagcgtgtagcggacgttgtattgcaccgggccctcgtagcgcagtagctcttcgaccgccccggggatcttgtcgcgatcctcttgcagcttctgccactggtcggggtggcgggcgaagatcaccgccgcgttgccgagcagcttggtgacggtctcggcgcccgcgccgcccagcagggtcgcgaagccggtgatctcgatgtcgtcgagcttgcgcatctggccgttttcgccggggatttcggcggcgatcagccggctgatcatgtcgtcctgcgggtcctggcggcgctcctggaccaggccgaagtagtacatcgccgtgtcgatgttggcctgcatgccggcctcgctgacctcaatctgccccggctcgtggtgcaggctggtgtcgatccagtggcggacctgctggcggtattcctcaggcacgcccgccatccgggtgatgacctccaccgggaacggcccggagaagtcctgcaccacgtcgaagttgtcggggtcggcggcgctcagatacttgtcgaccacctcgatgatggtctcgcgctgcgactggatcgcccgcggggtgaacgccttgttgagcaggctgcgcatgtggcggtgctcgggcgggtccatgaagatgatggacttctgttccggcgagatgccgcggcgcaccatcgccaggtcgcagccgcgtgccgaggagtacgtctcgtagtccttgaacgcggccgcgacgtccacgtgccgggtcagcgcgtagaaatcctctttttcgtcgtaatacaggggcgcttcctcgcgcatccgccgatagatctcgtacgggttgttgaagtagtcctcggagtacggatcgaagacgagcttcggtttggtcactgaatcctcctcagcggcgaggtcgggctgaaacctttacagcggagtccctgactgtaacggtaacggtaataccttcatgacgaaccgaaaagaccaaaacgctggtatttcaaaccctgttcgcgatcatcggccccacccggtcaaccgcttggtcggccccagccggggaatcatcggggatggcccatcagcgccagggccgcatcggccgcgtcgagcaccgcgccgccggccgccccagcctgctcggcgaggtcgacgaccagccggacatccttgcgcagtaacgctccggccacgccggccagctgatccagcccgccgatgccgccaagcgcgttgagcgcgaagctgtttccgctgctgcgcgagacgacttcggtgagccgctcggggcggacaccgagctgctcggccagcgacaaggcggtggccgcggtggccaggttcgcggtgaacagcaagttgttgaccagcttggtggtctgcccggatcccagctcaccgaggtgaaccaccggatcggcgtaggtttcgaacaccggacggcagcgctcgaccacgtcggcgtcgccgccggccatcaccagcagccggccctcggccgccgcgccaccgccgccgctgaccggcgcatcgacgaccgaaaccccgagcgccgcagcccgtttggcaagttttcggcaggtgtcggggtgcaccgtgctgtgcaccgcgatgaccccgccgggttgcatcgccgacagcagtccatgctcgccgccggtgagttcgtcgatgtcggcgtcgccgatgacgcacaggcagaccaggtcactggccgcggcgagttcggccggagagccggccaccttcgcgtcggtgtcggcgaatgcctcgagcgtcgcgggtcggcgtgcccacagcgtggtggggtagccgccttcgacgatccggcgcgccatcggcccgccctggctgcccaacccgatgaatccgacgcgcatcaacccgcctcctcctgcgccgccgtcgtttcgtgcgccgcctgctgcccgtcctccgccggctgcccgtcctccgccggctccccgtcggccgccgagcgtgaagctaatttcacgttcggcgccgggccggccgccgcgcaggcgttcgcgaaggacaacaccgtcgcgtgatagtcggccgccgtgtacccgaggctgatgttgtgcccggcgccgggttgccggtgcacggtgaactccggcgcaccggtgaacagcgccgcgatctcgtccatcgccgaagcgtcgttctgccagaccttttcgtgttcggcgatgctgaagtgcaccgggacacgcacggccggggcgagcgccggaaaatcccggcgggcccagttcgacaccatctggtcctcgtaggacggggcgctcggggagaccgtcgcaccgccgagaacctcaggcggataaaggttttccgggtgccacaacagttcgcgcagtccggcgggacgacgctcgcgcgtcgcggtcttgaggatctcccgggcggcggggtggtagtgccgaccggtgcccgccagctcgatgccgagcagatccgccccccgctcgtcggccgccatccgcagcacaagctcgcaaccgccggagtggcccatcaagaacagcccggcgccgcgcggccgctgcccgaggatgcgatccaccgccccgtaggcgagctcgacgcgctgctcgggccgcgtcatcgcctccggatagggggccgagctgccgtagcccggccggtcgagcgccaccacggtgaatcccgctgtggcgccggcccgcagcagcgagaacgaggggtggcccgggcagtcgaaatagaccgcggtggtgccgccgccgtggatggccaccagcacggccttgggatcctcggcctcggccaccagtgccgacatcggcacgccgtccacgatgacgagtcggggacgcggcgcggcgccgttcaccggtcggcccgcagcaggatcacgccgctcggggtcaggccgccgctactgacgacgccgacgcgggcgtcggcgacttggcggtcgcccgcctcgccgcgcagctgggtgatggcttcgtgcagcaggcccatgccgtgggtgcggccgtgcgaaagctgaccgccgtgcgtgttgagcggtagctggccgtcacgggcgatgttcttgccgccgtccaaaaactccttcgcctcaccgattccgcagaatcccagcgcctcgatccaggacaggcagttgaacgagaacccgtcgtacaactcggcaacatcgacgtccgacgggcgcagcgatgtgcgcgtccacacgtgcgccgcctggcccaacacctgcggctcgtgggtgagagtgctttggtcccaatcggttcgctcgatgatctgggtgcccaccgcctccaccagcaccggtggcttggcaaggtcgcgggcggcgtcgacggccgagacgatgacggcgatcgcgccgtcgcagggcacgtcgcagtcgtagaggctgaagggcgtggtgatgggccgcgcgcccaggtagtcctccatggtcatcggcgagcggtagatcgcggtcgggttgagctcggcgttggcccgctggttcaacgcgatccagcccagcgtctccttggtggtgccgtagcggtgaaagtgccgctgggcgttcatcgccagggtgtgcgccgccgaggtggcgccgaacggcatctgccagccttgcatccggcccatcgacggggtgatcttgccctgcttcatcagctcggcgtgggtggcctcccacagcgtgcggaagcacaacacgtggcgcgccaaaccgcctgcgacagcaagcattgcggcgatcaccgagccgccgggcccgaacgtctccatggcgccgttgtgccacgtcggccggatgcccagcgcggcctccagggcggtgacgccgccctcgcccatcccggcgacattgatcgcgccgggataggtggacaggccgtcgatgtcggcgtacgtcaggccggcgtcggcgatggccgcctcgcaggcctgcacggtcagcgccagcggcagctgcatcaaccggcgcccgatcggcgacatgccgatcccggtgagggcgaccttgtcctcgaacttgtcggtggtgagcatgggccggacgtggtcgccgaaccgctcgggggcgatttcgtcttccggcagcgggcccggctcaccaaccgcgctaggccgaaacagggggaaccacacgtcgtcggcctgttcgaagacgacctcgacggcctggccgagctcgagccggtcgggatcgcactccacgatgttggtggtcagccggacccgcgggtcctccgcgatcgccacctgcgcgatcacgtacggcgccggcattcccggcaggctgaagcggtggttgacggtgaatccggccagcgtcgccctgcccgagacggcccgcaccccgatgtcgcgggaccggcagtaccggcacaccggcgcgggcgggtggatcagcgatgcgcagctccgacattcctgcaggcgcagctttccgtcggcgcccgacgtccagaagaactcgttctcctcggtgaccaggggcagtgggcgtccggatgctgacacgtcacctccgcgagtagcacggtaggaccgttatacgattcggagaatcacgttatcactacttgcggacgcgcagaatgacaccgtcaagacggcaccgaggtgccggatcaaaagggcacccaggtgccggcgacataggtgccccattggtgaaagcgcacactccacatgggttcgttgggcgaccaccagggccgcggtggcgggggcggcacgtcctgcccggcaaacgacggcgcgtatggcggcgggggccggtaccagtccggcggcgccggtggcaccctgcactcacccgtcgtccgattccacgacatgttgcgatcgcactccgcggagctgactcccggcgtcgctgtcgccgctaccgccataccgatgaacgcgaccgcaacgacaaccgtcgaacgacggacaaaccatctcatggtgggcctcccgtggggccgtcccgatgacgttgggagtctcagcttattccggtgccaccgcgacgaccaggttcgtttcgccgacgccacgaccaccgagcgctgtcgtggcgtttcgtgtcgcgccggggttatgctccaagcgcgatatcaagtacttcacattgggaggtccgttgctcgaggcggagaagattctgatcaccggggcgacgggcaagatcgcctttccgatcgcgcgcgccctggccgcggccggcaacgaggtgtggggcgtggcccggctgaaagaccccgcggcccgcgagaaactcgccgccgccggtgtcaaaccggtcgtgctggacgtcggcgcgggcgacttctccggtctccctgaggatttcagctacgtcttgcacgccgcggtggacaccggcgcgggtgactggaaccgctgcctcgaaaccaacgcgcagcggtcgggcgagctgctctaccactgccgcaccgccaagggtttcgtgttctgctccaccggctcggtgtacgcctatcaggggcgccggccgctgaccgaatccgacccgccaggggtgccgctgcgggccaactacagcatctccaaggtggcggccgaagcggtgtgcacctgggtcgcccggcattttcagattccgctgaccatcatccggatctgttccacctacgggccgcagggcggtgcgcccgccgatcgtctggaagcgatgctggcgggcaagcccattcggttgcacccggacaagccgaacaactacaacccgatctatgaagacgactacgtggagctgggcatccgcgccatggaggtggccgccacgccaccggtcgtggtgaactgggcgggaagcgaaacggtcagcgtggaggagtactgcacattcatgggccaattgatcggtgtggagccgaaattcgagtacaccgagcgggcgcacacgccgctgtggcccgatgtcacccggatgcatgcagtgctgggccggacgaaagtgccctggcgcgacggctttcggcgcatgatcgaggcacggcacccggaaatcactctgcgccaagccgatccggcaacatcctaaggactgctgcgatgcaactttccggaaggccatccgacgaagtcgccgaggtcctcgcgaccgggcggggcgagatcaccacgttgttcgtctcgatggcaactcgccatcccgacgggaacgacgccgactacctgcgctggcacacccttgaccaccgcccggagcagcatcgcctggccgcggtgcgggcctcgctgcggctggtgtccacgccggcgtgccgggcggcgcgcgcggtcggcgacgggccgctggacgcggtcgaccacgtgatgacgtacttcttcaccgacgcgtccgggctgcgcggcttcaacgaactgtccaccgcgctgggcgacgccggccgcaaggtcccgttgctgcccccggtgcagcgcggcgtgtacgacgtggggcgcaaggtggccgcgccgcgggtcaaggtcggcgccgatgtgctgccctggctgccggtgcgcggcgcggtgttgctggtggagcggggatcggcgccggtcgatccgctggtcgaggtcgacggcgtcgccggggcgtggtcggcgtcgtcccggcggatcttcgccgattccggcaacgcgcaacaagaccagtcgatcacctactgctttgtcgacgacgacccggtcgcgaccgcccagcggatgcggcaggcgctgaccgcgcgctgggccgacgcgggcgtcgaacccctgtttgccgcaccgtttttcgcggtggtgccctacgaatgggatcgctatgtcccgtagccggggggcggcgtgcgaatcggattgatggtcggctcggacaaggagcggacgcgtgctgagcggctggccgggctggtcgacgacgcggccaccgccgaacgcggcggtttcaccgcgttctggatgccccaggtgcccggctacctcgacgcgctcaccgcggtggcgctgatcgggcaggccaccgagcgcatcgagatcggaacggcggtggtcccgatccagacccgccacccgatggccctggcgcagcaggcattgaccacccaggtcgcctgcggcgggcggttcacgttgggcatcgggccctcgcatcactggatcgtcaacggccaactgggactgccctatgaacgtccggcacgcctgacgaggaactacctgcaggtgctcggcgcggcgttcgccggaccgggcagcgtcgacgtcgacaacgaaagttattgcgtgcattcgccggtcgacgtcacggattcattcggtgtctcgatcctgttgtcggcgctggggccgacgatgctgcaactggcgggcgagcgcgccgacggcaccatactgtggatggccgacgagcgggcgatcggcgaccatgtggtgccgcggatcaccgcggcggccggcggtgccggacggccggcgcctcgagtcgtcgccggggttccggtcgcagtctgctcgaacagcgagatcgacgatgcgcgagcctatgccggcgagatgctcggtcacgcggagttctccccgaattacgtccggctgctgcagcacggcgacgccgaagacgtcggcgacaccatggcggccggcgacgagtcggccgtgctgcgcaggttgcggcggtaccgcgacgcgggcgctaccgacctggcggcgcggatcgtgccactgggcaacgacgcgcgcgagcgggccgaatcgcggcgccgcactcacgaattcctgtcgtcggtgtgcccggcgttgtgaggctcagcgggtgaagccccactctgcttcgttctcttcggttttcaggtgctccgccggatccgtcgcctcggccagcggtgggcgatgggaaggggcggtgcgctcaccgatctcggcgatggcgtgcaccgggcagtccagcagggcgcgcatcaccgcgtcgcgatccgcctcggccaccgtgccgtcgccgatcagcgacgcgtacccccagtcgtccagcgagaagtatcccggcgcgtgcttggcgcagatgccgaagccgtcgcacacggtgcggtccaaccggattctcatgcctgcctcgcaacttccgcctggtagggacggtcggcgcggaacgcgccgcgggtgcaatccgggcacgacccgtcgagatgggccgtgacgtcgtccgggaactggtcgagcaggctgaaggccacattggtggcggcgtccagcgtcgcgcaggcaccgcggccccgcagcagcaccgaccagcgccgcaaccggtcgacgtcttcggtcgtcgcggcgccgtcgcgcagcgcaccgccggcggcggccatcgccgccgtcccgttgaagcacgacccgcactggccggcgttttcgcgatcgaagtaggccagcaccgacgccgcgaccgcgacggggcagtcgtcggtgaggaccgagatcgcaccgcagcccagtccactgccgaagcgccgcatcgtctcgtggtccagcgtggtctgcagcacggagcgattcagtaggccggcgaagtagccgcccatcaacgcgccgcgcactgcgtcggccgagacaccgtgcagggcaaggagttcggtgaagggcgtgccgtggacgagctcgtagagcaccggtggccggccggccccgctgatggtggccaggaaggtgcccggcgacaggggggtgccttgcgcgcggaacgcggatgcgccgtgggactgcaggaagggcaggttggccagggtttccacattgctcaccagggtgggccggtcgccgacgccggcctcgaaggggcgcggcggtttgtcggtcggcttggccggaccgccgttgagcgcgcggacggcggcggtctcctcgccggccacgtatccggccggcaccgtcgacagcgtgaccgtcacaccgccgagcgtgtcgggatccagctcgcccagcgcggattcgacgctgtgcgcggcttccgggtcggacacgtacacgtagccacgctcggcgccgaccaccgcggccgccagccgcagcccgtccagcaccaggtgcgggcggttgcgcagcagccaacggtccttgatcgaagccggttctccctcttcgccattcgcgacgacgacggtgccgccggccctgggcgccgcgcggccgttgtcgcggacggtgcgcaacttcaccccgagcgggaacgccgcgccgccgcgtccgaccaggccactggcctcgacctcgctgagcaactggtcgccgtcggcgagcgggcgatagccgccgagcccgcggtacgcggcgaggtcttcacgcccgggctgtccggtcagcaaccgcggccggcagcccggcgcgattgcggtgacgacggtggtggactgtgtggtgttcacggctggcctgccaaggtgttagttaggcttgcgcacatgcgaactgcggtggtgcgcgtcaacgtcgacccgaagagtgagtgcacggctgcacaactacgcgacggcatggcagcgctcctcgggctcgcgcgcgcggcgggcgccgacgtcgccgacaacgacctggccgccatgccggcgagccggcgcgaggtggagttgctcatcgccgccgaccacggcgatgcggccagggacgtcgctgtcaccctgtgcgccaaagcgtttcagtccactccggtgccgggggtggtcaccttcatcagccggggaaccgacgacgacgcgcacggggtgctgtcggggttcgggctcaccggggacatcgaaaggaccgccggggacgagggattcgacatcgtctacgtgacgctgcgcgagcaggacctggagcggattccggaaagccgcatccacaccgccctggaagcgtcgctgaactgcgaagtccacatccgcactcggtaaagccatcacgaccccaaaaattccaggatcgcgggtgcggcctgcacccaggtgtcgaacatgttgaagtgctgcacccggcccgcggcgcggtcctcggacgcgcgctcccatgcgtcctctggccagggcggatcgatgagtttggaccccttgatcaggcagctcacttccagcgatgtccgtttcgggtgatccatgtcgttctcgccgccgcgaatgatcaaggtgggcaccgtgattcggtcgaacatctcgtcctcgacgcccgggatggtctggcccggcttggacacgaacgcgttgagccagcgcagcatcaccttgaggaactcgccggagtcgaaatcgaggaaccgctgcttgttggccgggttctcctcgatgcgttcgcgccattcctgcaccttgatcacaccgtccatcccggtgccccgcaccgcgaggatgctggggatgatgtagaaggagccgagcacaaaggtgccgtagatgccgccgacgatgttccacaccacgagtttggtcaccatctcggggtagagcatcgtggtcagcatggaatcccttgccccaccggagcctccggccaggatgcagcgctcgaagcccagcccggtcaccagcttgtgcagcgtttcggcgcgcatgtgcgattcgctttgcccgtagaactgcacatcggaagcgccgcaattgggccggtcccacagcagcacccgatagccgccggcgaccagcgcatcggcgagcggccgcaggccggggatctgcatgctgaaccgtccgcccggcgtcagcgcgatgagatcacctgagtcaccgaggatttcgtagaccacattcccgccgttgacctcgatagaaggcacccgattctcctgtagctaggcctgcaccacgacgtcgttgccgacgacgcgcaccgggtaggtgcgaatactccactccggcttgaccgcggtggttccggtcgccagctcgaaaccccattggtgccaagggcagtagatgtactccaggtcgcgcaccatgaccgagtcaccgggcgcggtctcgtcgacgatggtgcgcccccggggccgcccggaacacagcgggccgccctggtgtgggcagtagttcgcgatcgcgtaaaaggttccgttgacgttgtacacgccgacgccgtggcgaccgatcggcaccagtttgtgtgtgcccggcgggatttcgtctaccgtggccacgacgcgctcgcggccctgggcgagtcggggttcgggccgcttggtctgggccccctcggtttcggatgccaattcagagcacccggacctggccctcgagcaccggcaccgtctcgggcaggtgataggtggcgatgccgttcttgtacatcaccgcgtcgcgggccgccttgggaaggtgcttgaccagccagcgtgggtcgtcgaacgtccagtgcgggtagtccgaggagtagagcaggatcttgtcgcactccatccattccagcgcccgggtcagctcggtcttgtcctcggggtagtccagcggctgggtggtgaatttgatgtggtccttgacgtattcgcttggcttgcgcttgatctccacccgcgacttgcgggcctcgtagatcgcgtccatccgccacatcagcggcaggatccaggtgaacgcgtgctcgacgaacacgatccgcagggtcgggaaccggtcgaacaccccgtcgaagatcaggctcatcacctggttggcggccagcagcgagtaggtgaccatgaaatcgtggttgtagctggggaatccgaccggcggcgtcggcagcatctcgtaattgctgcgcgacaggtggcagctgaccacgatgtcgtgcttggtggccgcggcccagatggggtcgtacttggggtgtccccaggacggccgcggttcggccttgatgaggatctgcgccatgtagggatggccggcccacttctcgatctgctcgacggcgccctcggggtcctcgatggcggcgcagatcgagccgcgccagcgttcgtgccagttgttgcggctgtccagccagtggttggcctgccagtcgttgagcgcgctgcagtacgcctggtgcgcctcgccgatccgcggggtgcgcccggcgggctcgaggatggcgatgtcggagcccgcctccatgatcagctggcggaacgccatgtccgggtcgctgccggggaactcgccgtccggcgggaaggtgtcggtgcgcatcgcgaaggcgtgcgcatagtcgggggcgtcgtagtagatgagttcgccgactcggtgttcgaagaagaatttgcgccaccgctcggggatgtacggggtgatctcgccccgcttgggcaccgggtgcacatccgagtccacgcaccggacggcgatgcgttcggcggcggggacccgctcctgcatgtgggtgagcgtcatggcgacctcctccgtatccctttccctattctgcgactagctcgcggccaggtcgacagaaatgtcgatcccgtacagatccgccgcggtgcgccagcacagcttctcgcgctgctcggcggacagcgccggcggcagcttgtgcacgtcggcgcactgccagtgcggatagctggagccgaacatcaccatgtcttccttgcccgtgaagccgaaccactccgccgcgaagtcggcgtcgccgggcccgtccaggctgccctgcacgaaatacacgtgcccggggatgtaatcgctggggatgcgcggtgcccacggcgtctgctcgaggtgcggccggccgaaggtgtccatccgccacatgaacggcgtcaggaagtcggcggcgccgtcggcccacacgaatttcagtgcggggaaccgctcgaacacaccctcggcgatcatgttcatcaggtgatagatgtagttcagcgccatgaagctgacgtattgctcgtaggtttgcgtgtgcccggacggggtgggcggaaagccgatgccctctccggtctcgatgtgcacggccaccggaaggttggcgtcggcggcagcctcccagagcggccagaactgcggtttgccgtacagttcccgcgactgcagcgggatgccgagctgcacgacgcgcgagtgggaccgccatctctccagctcgcgcagcgcgccggcgatgtcgtcggggttgacccggatggtgccgcggaacttctcgccgaactccggtgagtccagccagcgcgacaccatcatctcgttgtgcgcggcgtgcagcgcgctgcccagatgccggtccggcatgatgccgcgccccatcggatgcagcacggcgacgtcgacgccgcgtttcgaaaacagttcgtgggcaacgaattccgggtcggaaccggggtactggccgtcgggcccgtcggtgttgggcgcgtactcgctgcccggcgcgccgtaccagtccatttcgtagtcggggaaaccgcggctcttgaacggctcgcgcaggaaggaacgcaggtccttgttggacgggaagaagatgtgcacgctggcatcgatgacgggcgtacgtgttccgtcagcgtgttcgatcacgagagccacccttcggctccggcagccgaagcgagccgggcaagatcatctgataggcaatctaacattctcgtcggcgccgcatcaatgggtttccggtaagcatttcgtctaatcatcttccctggtgagagggcatttatcggctggctgggccacttgggttcttcaattaggataataacattctcgcacggattagtaacggtgcgtcgccccggcggggccgtcgcggttaccgcgcggaccggcccaccgtgacgccggcggcccgctccagcggtttgatcaccgtcgtgaaatcggcctccggcccttcctcgcgcgccgtggtctcccacagccgggcgatcgtctcggccacctcggcgggcacgccgagcgcgctcgcctcgtcgagataaaggcgcacatccttgaccatcaggccggtggcaaagccgtagtcgaagctgcgcggcaggatcgcgcgggggaacttgtcgcggctggcgctcgtcgcgccggatccggcgttgagcacctcgatcatcacggcggggtccagcccggctttgacccccatcacgacgacctcggccgtggcggccaagacgttggcggccaggatgttgttggccagcttcatcgtctgcgccgcgcccggtttgtcgccgacgtagaagggtcggcccagggcttcgagtgtggttcgtatgacgtcgaattcgccgcgcgggccggacaccatgagcgccagcgtgccctgctcggcgccgccgacgccgccgctgaccgggctgtcgatggccacgatgttccgccgcgccagcaggtcgtggatccgcatcgccgtccggctgccgacggtggacaggtcgacatagcgcttcacccgtgcgccttcgatcacgcccgcggtgccggtggccacctcgagtgacgcgcccggggtgggaaggctggccagcaccgtttcggcgccgtcggccacctcttttggcgacgaggcggggcgcgccccggcggcgacgaggcgttcgagggcctcgcggcggctgtcgaaggcgacgacgtcgtgctgttcgcgaatgagccgagatgccatgggaaatcccatgtttcccagcccgatgaagccgatcgtcatgagttctcccgatcgagttcggcgaacgcctcgcgggcgatgcggaagctgtcaaccgccgccggcacaccggcgtagatggccacctgcaggaacacctcgcggatctcctcgcgggtcacaccgttggtcagggccgccttgatgtgcatccgcaattcgttgggccggttgagcaccgcgatcatcgccaggttgagcatgctgcgggtcttgcggggcagctcctcgcggccccacacggcaccccagcagtattcggtgacgagatcttgcaggggccgggtgaactcgtccgcgtcggccaacgcccggttgacatactgctcgcccagaacgtcggagcgaattcgcaacccccgctcgtatctttcgcgatccaatgcacttctccttcgctgaggtccttcgctgaggctccgattgcctgagcgcagtcttacaccgtgccccgggtccgcaggtctacagtcgagggtcaaacggaccgtccccgtccgcggtggcggactgccgggccgcattgacagctaattggcttgtgggggacggtaatacgttttcggatgaccggggaaaggtgaggagaggcagtggctcaagcaaccgctgacgtctgggaagtgatgtcgaccgcccgcaccatccggcgcttcaccgacgaaccggtggacgatgcgacgctggcgcgctgcctcggggccgccaggtgggcgccctccggcgccaacgcgcagggctggcggttcgtggtgctgcgctctcccgaacaacgggcggtggtggccaaagccgcggcccaggcgctggaagtgatcgagccggtctacggaatgagccggcccgcccccgacgaccacagccgtcgcgcccgcacctaccgggccacctacgaattgcacgaccgcgcaggcgaattcacctccgtgctgttcgcccaggcgcactacccgacggcctcggagctgctgctcggcgggtccatcttcccggccatgcagaacttcctgctcgccgcccgcgcccaggggctcggcgcctgcctgaccagctgggcgtcctatggcggggaacaactgctgcgcgaggccgtcggggtgcccgagggctggatgatcgccggtcacatcgtcgtcggctggcccaagggcaagcacgggccgctgcgccgccgtccgctcgccgagttcgtgaacctcgaccgctgggacgccccggccgacggcctgctcagcggcctctaacgcacgggaattccggcccgccaccgccgtcgcgtgagtccatgcccggattccgagattattacttccgcaacggagaatgttattctcgccgggacggtcacgacgagaggcggcgccgatgctgttggaattcgatgctgatcagcggctgtggcagagcacggtgcgcgatgccgtcaccaagcaatgcccgccgtcgctggtgcgcagcgtggccgaggagggcgtcgaccccagtccgttgtggaagtcctacgtggaccagggctggaccgagctcaacgacccggagagcaccgtcgagctggcaatcgttctcgaagagctgggccacgccaccgaccccacacccttcctggcgacgatgagccagttcgcgccgctggtgggcgagcacttcgatccgcaccagtccgggaccgccgtatacggcggggtctgcgcctaccgggacgccgacggttgggtgttggacggcaccgcgcgccacgtgctcgacggcgaccgcgtcgaccgcctcgcggtggtgaccgacgccggggtgttcatcaccgcggccaatcaggtgtcggcaaggcgcacggcggtgttcgacccggtgctgcacgtggccgacctgtcgctcgccgaggtgcgggtgcccgacagcgcccggctgagcgtcgatcccgagcgcgcacaccatgtggcgctgaccggcatggcgatcaccatggtcggcgcctgccagcgcatcctcgatctggcgctcgagcacgtcaaaagccgtcagcagttcggcgtgccgatcggctcgttccaggccgtgcagcacaaggccgccgacatgcacgtcgccgtgcaacgggcccgcgcgctggcctatttcgccgcgctgacgatcgcggccgatgacccccggcgccggctggccgccgcaatggccaaggcgtcggcgggggagtgccagtcgctggccttccggcacggcctgcagctgcacggcgccatgggattcacctgggagaatgacctgcagttcgcgctcaagcgggccaaggcgggtgagctgatgctcggcggcgcggcggagcaccgggcgcggatcgcagaggaataccgtgcagctgacttttgatcccgacgtcgaggcgttccgcgccgagttcgcggcgttcctggacgaaaacctgcccccggcaagcgaaaccctggaccgtccgcgatcggtctcgcacatgccccagtgggcgcgccgctggcaacggctgctgttcgacaacggctggctgctgcccagccagccgccggagtacggcggccgcaacgccacggtgctgcaacagttcgtctatctcgaggaactcagccgccgccggatctaccacagcttcaacccgcagggcgtgaatatcgttgcggcatcgctgttgtcgttcggcagcgacgaacaaaagcagcgctgggcggtgccgatcctgcgcgccgagatcaccgcgtcgctgggcatgagcgagcccagcgccggttcggatctcgcctcgctgcgcacccgcgcggtgctggacggcgaccacttcgtggtcaacggacaaaaagtgtggacctccggggcgcatgacgccgacgtcctgctgaccttcgtgcgaaccgatccagatgcgctcaagcacaagggaatcagcgccctggtgatccccaccgacaccccgggcctggtccgccggcccttcccgtcgatctgttcgatcgacgacaaggacttcaacgaggtgttcttcaccgacgtgcgggtgccggccgagaacctggtcggtgaactcaaccaagggtggctggtggccaacggttcgctgggtcacgagcgcaccatgatgtggctggggttcgcggaccgcctggagaacatgatcgccgacttccagcccggcaccgaggtggagcgcgaccagtacgccaccacgatcatggacagacaggcgctgcggctgctcggctcggcggcgctggcccgcgccgcccgcggcgaagacgacgttgccgccatctcggtgctcaagctgctcggttcggaagccgagctgcgcgccatggaactggcgctcacctccgcgggcgccgacggactcgtgcaccccgggcagaccgggccgtacgcgcacatgaacctcgaccactacttcgccagctggttcgagcgctacgcgcgcagcttctccgggaccatcgccggtggcacctcggagatccagcgcaacatcatcgcccagcgggtgctcggcctgccgcgcggttagcgccgtcacagcgcttgccgagagacgttgctgggcaaggaaatccgactcacccccggagtgcccagctggccggccagccacggcaacgcggtggcgaaggccgtgccggcggtcggccagtcgtggtgtccgccctgtgcgacgaccgcgcagtcgatgccgttggcccggcccagcgcgcacagcgaggcggcagcggcggcctggtcacccggatcggtagcggcccggcccgcgaccgccatcgcggtggagtcgacgtcgcggcgcggtgacggcgagccggtcgaggagaccgcgaaccatccggacactccggtgtagcggccgtggcgggcgatcaccgtcgccggatcgaatgccgcccacgcgtcggcattgccgtcgaacaggtcggcgatggtctgctccctggttccggtgttgggggtcaggtcgccgtcgatgtcgacgaacgcgctgaacagcgccggatgcatgacggtcaggtccaccgagcaggtcccgcccatggaccagccgacgatgccccaccgggacgggtccttactgacgccgaaagtcgagatcatatagggcacaacgtctttggtcaggtggtcggcggcgttgccgcggccgccgttgacgcattcggtgtcgttgtccaacgcgccgcccgggtccgcgaacaccagcaccggcgagttgccactgtgggcagccgcgaacgcgtcgacggtgtccaccgcattgccggcgcgcacccagtcggcgggggtgttgaccatgccgccgatcatcagcaccgtcggcagctgcggcggcggatagctcgcgaaccacgccggcggcaggtacaccagctcctcgcgatgcttgaaatgcgaggcgtcctcggggatctgcaccggcaccaggctgccgtgcggcggtttggcgccccgggccgccagtgtggtgacggtggtcctgtcggtctggtcgggcagcggaccggaggtgaactggctccacgcactctgcacggtttggaagtagccgacccactggttgagcaccagcagcgagcagagcagacacagcggcacggccaggatggacagcccgcgtcgccaccaccgcgcaccgcgccagcccaggagcaggatcgcgatcgccatgccggccaacgcgatccagacgaacagcgcctgcggcgcccgcgtgctgatgcagcggtgcgccccgacggccgtcgtcacccccaaaaccgcggcggacggcagccacaacagccgccagcgccgcgaccgccatccggcggccaggctcagcgttatcccggccacggcctggatcgccaccggcagccacccatgcgccagcgaaatgtggttgctcggcatggcgattcctcctcggcgcatcgatggttcggctgagaagaggatcgaatgccggcctcgcggaatccttgacggattcttggaggccgtctgggtggcccgcgggccgcagcgcgaagtcaccgcgttgactgtcacgccacggcggccgttgtcagcgtgtcgtcgccgtcagcgcacagtgaatgccggcggcgcaacggcattcaccgggcgcctagaccgggtcgaatttggtgatgagccacttgccgttgaccttggtcagactcaccagcacgctgctggacgccatcgccgggtcggggttgtccttgctggtggtgctctggtcgaccagcaccagcacgacggccgagtccggacgtagatccgaaaccgcggcccccaacacccgagcgttggttttcagcgatttctgcttggcggccggagccacgatctgctcggtgaattggttgtagtacgacaggaaatctccggacaggtgcgacttggcggcggcgaagtccttgtcgagcgtgtcgggcgagtaggacagcagcgcgaccgttccgtcggacgccgcattgaccaccgcgctcgcgacccgggcgtcagtgcgcttgtccggcaggtactccttgaagtagagccaggccgtcccggcgccggaaatcagcagaagcgaaatcaaaacgatcggaacaactttcacgttgcgtcgcccgcggggccgaccgggttcgggccggtcagcagagtcgtcggcggcgtcgctgctgcggttgtcctcgctcatggaacgaactccagtttggacatcttgtactgtccgccctcgtcggtgacggtcaccttgagccgccagttgcgcggctcgtctttggcgccggcggcgttggtgatccgcgacgtcgccgcgacgagcaccaatgcggaattcccgtcgatggattgcacggccgccgcgttcacggtgccctgggtgaccaccttggactgctcgacgacggtggtgaaatcctttgcacgctgctggaagtcgtcgcggaactggccggtcgagctgtcgatcacccgctggacgtcctccttggccttgttgaagtccagggacgtcatgttgaccaccccttgccgggctgccgccaggaagttcgcgatgcgctggttgcgctcggaggtttgatggcgctcccacatcatgtatccgctggcggcgacgaaagcacagatgagggcgatgacggccgctttccacgccacggaccacgacggcaaccgcaggcggcgggagcgggccttggattccgattccgcgtcctcggcggtttcctcggcggcttcctccttgggctcggtttccttggccgcctccttggtctccgcttgcgtggtctccgtgtcgtcggcgtcggttgcttccacgctgtcggagacctcatcgtcggtctccgccgcctcgtcgtcggccgcatgctcgtcggcttcggaggtttctgcagcggccttcgccgcctgagcctgcgcttcccgccggagccgggcggcacgggcgcgggcgcgcgccgccgcggccagcgcttcggcttcggccgcttcggcctcggcctcctcgagcaacgccttcacgtcctcgtcggaggtggccgaatcgtgcggcggcttcttcgcatcagccatggtgctcgctgcccgtcgccctcatgatcgactgactcctataggtctcacgcggctaccatcgcacgagcgagaacggccaactgttgctgccccccggtccgccgccgcaaccggtgtcgaacgtcgagtcgacctgacccgacatcgtcgccgggtcccacgagtaaacatcgtgcgagggaaagaactggaccacgcagcgcacaccatcgggaacgtcaactgccatggtgtagcggccgttggacagatgtgcgtccgacttccaccacgccgcttgtccgttcggttgcggaatcgcttcaaccgtcagacattccggtcctcgatcgtagctgcagggtctgatcgcccagatccagctgtggccgggatcccgggccgtgtccacccggtagttgccgacctgcatgtcggcgtgcgcggtcggcgtaagagtcaacgcggcggtggcaagcgcaaggcccacggcgaaaggcttcaccgatccgtctcccatctctgcacaggttcgtggcccgaatataaggcgcggtcacgctgaacagggcctactccgaaaaatcgcgacagtcaacggttcgtcgagaccctagtcgatgacggcggcctccttgcgctcggtgatcggccgggcgagctcctgctcgtcgcagatgcgttgcagtttctccagcgtctcgtccagtccggcgccgatccggcggcccggggtgaatgtggccggcagcttgcgcatgccctggatgacgccgatggtctcgtagtgcacggtgccctcggggtcgcagcggtagtccggcatccggtcgagcacggcgatgagcatcgacttgaacacggtgcgcgccacgttcgacccgatgcagcggtggatgccgagcccaaagctgaagtgccggttgcccttacggtcgaggatcacctcgtccgggtcgtggaagaccgccgggtcgcggttggccatcgcccaggagatccacagccgctcgccctccttgaacacggtgccgtcgagttcgaagtcctcggagaaggtgcggccgtcgccgggcgccggggtgaagtagcgcaggaactcttcggtggcgggatcgagcagcgttttgcgttcgtcgctgagcagctgtcgttgttcgggatgctcggacagccattccagcgaatgggcggtcagggcggtcgtggtgtcgaacccgccgccgatgaccagccccaggttgccgaggatttccaggtccggcgcgggttcgccgtcaatgcgcatctgcagcagcgcattcacgatgccggggcgcgggttctcgcggatctcgagcatgttgttgaccatgtcgaggcccatctcgcggtgcatggcggtgacgcgctcgatgtcgggagagtgctcgggcgtgtagaccgcggcgtgcaccggctcgctgtacatcttccacttcttcagcggaatgcccagcatcgccagcgtcaggacggccggcacgatgttggccaggtcgtcgacgaagtcgatgctgccctcttcgatcttctcgtccagcgcggcgcgggtcacctcgtcgatgaacggctcccagcgcttgaccgccgccggcgacaggtacggattgagcaccgtgcgatagatgcggtgctcggggtcgtccatttccaggatgccgccgcgcaccgcgctgacgcggctggccgtcgggatcgaaatgcctttgtagccacggcgttcgccgttgatgtcatggtcgttggacacggcggggcagcgggcgagttcgaagacctcgtggctgccggccgccacccggtgcccgccgtaggtgtccgtccacgcatcgggcacttcgcgtgcatctcctcggtgatcgccttgaaccgcgaccgatagtccggggaatgccggtcgaagtgataccggttcttcttacggtcgctgtcattgacgccgtcgtcgacactcaacgcttcgtctccctcgatgtctgttggtcggtgccggctcaggcgtcgtcggtgatcatgatggcctgctccggacacgattgcgcggcttcgcgaacctggtcctcgcggtcggcgggcaccacttcgtcgatcgccgatgaactgccgtcgatgtcgctgagctggaacgaatccggggcgatcatcgaacacagggtgtggccctggcatcgctgcgaatccacccaaaccttcacgggctgtctcctctcacctgatgcttgttgccgggcgccgctgaccgatccccaccgctcaggtgttgcggccgccgttgacgcccaagatctgaccggtgatgtagccggcttcctcggacaccaggaatgcgcaggccgccgcgatgtcctggggcgtgcccatccggcgcaccggggtccgggcgatggtctcctcgatgtcgcccaggaacccgttcttctcggcggcgcgcagcatcggggtgtcgatgaagcccggcggcacggcgttgaccgtgatgcccttgggcccgtactccagcgccaacgacttcgtgaggccgttgaccgccgacttggccgccacgtaatgactcatgtagggcgcacccgaatgggtgctcgacgaagagatgttgacgatgcgtccccagcccgcctcgatcatgtcgggcaacaccgcttgggtggtgtggaagacgccattgaggttgacgtcgatcacccgctgccagtcctcgaacgtgatgttgttgaacttcttgaagccgtccaggcccgccgcgttcaccagcaccgtcaccggcccgagttgggcgcggattgccgacagcgcggcgtctacctgcgaccggtcggtgacgtcggcggtgaaagccagctccgcatccgacggccgcaggtcgatggaggcgacgttcaagccgtcggcgcgcaaccgctcgacgacggccagcccgatgccggatccgccgccggtgaccaccgcagtcttcatctcgaggcctctgcttcgaaggacgccatttcagtcacaaagaatctcccttacaattatgagaaccttactctccgttcggagcggcgtgcaacacgcgcacaacaccgcgtccagcctgcacggagaggccgggatccacagcgtacggccgttcgcgccgctggtcagcagctcgatctcattcctgagactttcttgaattatcgaaactcgaatgtaagattcgccggggaagagaatgaaattatcgtgaccgccaccacatcagggggtaccggaatgcctgcccaggacacggcagagcccgtcacggggagctcagcgaccgccgcgacggccgacgccgcgcccgccgcccatgtcgaccgccggctgttgatcgacggtcggctggtcaccgccggcacgacattcccctcgatcaatcccgcgacgggcgcggtgatcgggcacgcccccgacgccggcacggccgaggccgaagcggctatcgcggcggcccgccgcgcattcgacggcaccgactgggccaccgatgtcgagctgcggatccgctgcctcgaccagctgcaccgggcgctgctcgagcacgccgacgagctgcgggagctcaccatcgccgaagtcggcgccacccgtgcgctgacccacggcgctcagctcgacgagccgatcggaatcgtgcgcttctacgccgacctgctgcgcagctatccgttcaccgaagacctcggcgagaaggagtcgcgcggcctgcgccaccaccgctgggtggaaaaggaagccgccggagtggtgggcgccatcatcgcctacaactatccgaaccagttggcgctggccaagctggcgccggcgctggccgccggctgcaccgtggtgctcaagggcgccccggacacgccgctggtcaccctggcgctgggcgaactgatcgccaaccacaccgacatccccgccggcgtggtcaacgtgctcagttcggcggacccggccgcgggcgtcgccctgaccaccagcccggacgtcgacgtcatcaccttcaccgggtcgaccgccgtcgggcggcagatcatggccgccgcgagccagaccgtcaagcgcgtcttcctggaactgggcggcaaatcggcggccatcatcctcgacgacgccgacttcgccggcgcggccctgttcgcggccttcagcatggtcacccacgcgggccagggctgcgcgctcacctcccggctgctggtgccccgctcgcatcacgacgagatcgtcgaactgatcgcgcagaacttcgccaaggtccggcacggcgatccggccgaccccaagacctacatgggcccgctgatcaacgagcggcagcgcgacaaggtcgacggcatggtccagcgggcggtggccgccggcgccaccctggtcaccgggggcaagcggctggatcccggcttcttctatgcgccgacgctgctgaccaatgtcgacccggacagcgagatcgcccaagaggagatcttcgggccggtgctcgtggtgatcgcgttcgacgatgacgacgacgcggtgcgcatcgccaacaattcgatctacggactggccggcgcggtgttcagcggcgaccaggaccgggcgctggccgtggcgcgccggatccgcaccggatccttttcgatcaacggcggcaactactttggcgccgacagcccgttcgggggtttcaagcagtccggcgtgggccgcgagatgggggttgcgggattggaagagttcttggagcgcaagacctttgccgttgtcgcggggccggccgagggggcgctcgcatgaggccgctggaaggcatccgcgtcctggaagtcgccatgtacgggttcgtcccgtcggcgggcgccgtgctggccgagtggggcgccgaggtggtcaaggtcgagcacgcggtgaccggtgacccgcagcgtgggctccgccagaccgggatgctgcgcgtcgagggcgatcccaaccccaacatcgagcacgccaaccgcggcaagcgcagcatcgggctggacatatcggtgccggagggcaaggaagtgctctacgagttggcccgccgctcggatgtgttcctcacgagcttccttcccgctcaccggaagaagttcggcatcgatgtcgacgacattcgtacggtcaatccgaagatcgtctacgcccgagggagcgcgctcggcccccggggcgccgaatcggaaaagggtggctacgacatgaccgccttctggtgccgggcgggaaccgctgcgacgatcacgcccgccggcatgccgggaatgatcgccccgcccggaccggcctacggtgacaccatctcgggcaccaacctggccggcggcatcgcggcggcactgctcaagcgggagcgcaccggagaaccgtccgtcgtcgacgtctcgctgctgggcagcggtctgtggtcgctgggccacaccgtcgcgctgaccaatcatctgcaccagcggctggaatcaccgccgcccggagtgcacggcgcgccgaacaatccgttggtggggctgtacacgacctccgacggccgctatatctccttcgtgatgatgcagcccaccaagttctgggccgacgtgtgccggcatgtcgacctgcccgagctggccgacgacccgcgcttcgacacggccgaaaacattgccgccaacacggcggaagcggtggaactgctgaccaaggccatcgccacccggacgttggccgaatggaccgagcgcttcgccaccctcgccgggccgtgggcgccggtccaggacaccctgcaagcggccgacgatgcccagatccgggcgaacgagtacatcgtgcgggcgggcgagctggagctcgtcgccaacccggtacagttcgacgtcgcagcaccgcagaccgggccggcccccggattcgccgagcagaccgacgagatcctgatggagctcggcctcgactgggaccgcatcatcgaactcaagacggccggcgccgtcacctgagcactaccggactggagcagcccctgacatgcctgagcggactgtcgcatgtgttggcacgcgggtgccttacgcgtttgcgcaaagcgccgagcgcgcgataacggttatgcatttttcgctccgcctggacgcggcatgagtcataatcgccggacgcttcaagacgtggagcccctcgttttgcggcgccaactcacgcgacagaacggaggtctggcgtgagcgaagcagcggccatcggtgccgaaaaccagctgcccgccgggcatttcgccgtcgccggtacgaattcacagccgtcaattctgctgaatttaccgcagccgttgcccaagaacaagactgacggtctcgtaacgcgggggagggtctgaggccgatggcggatttgcgtgccgagcgatggtcgacggggttgcccgcgctgcgactgaaggtcgacatgtccggggcgatgcaggccgtcggagcgttgttcgccatgtcggccgacgcggtcaagtacttgtttcgccggccgttccagtggcgggagttcctggagcaatcctggttcgtcgcgcgggtgtcgttggccccaaccctgttggtagccatcccgtttaccgtgctcgtcagcttcacgctcaacatcctcttgcgtgaactgggcgcggcggatctgtccggcgcgggcgccgcgttcggtgcggtcacccagctcggcccgctggtcacggtgttgatcgtggccggtgcgggtgccaccgccatgtgtgcggacctggggtcgcgcacgattcgtgaagagatcgacgcgatggaagtgctgggcatcaatccgattcagcgcctggtgacgccgcgcatgctggcttccggtttggtggccttcttgctcaacagcctggtcgtcatcatcggcgtcctcggtggctacgtcttttcggtgtttgtccaagacgtcaatcccggtgcgttcgccgccggtatcaccttgctgacgggcgtgcccgaggtcgtcatttcctgtatcaaggcagctcttttcggcctcatcgccggtttggtcgcctgttatcggggcctgtcgatcaccggtggcggcgcgaaggcggtcggcaacgcggtgaacgaaaccgtggtgtatgcgttcatgtccctgttcgtcgtcaacgtggtcgtcacggcgatcggcatcaagatgacggcgaagtaggaggctgtcggtggcgctgagggctgcatacccacgactgacccgccaactcgagcggccggtcgccctgctggcggggatcggcgaccatgcgctgttctacggcaaagcgctcgccgggatgcccttcgcggctacccgctacacgcgcgaggtcgtccgcttggtcgccgagatcagcatgggcgcaggcactttggcgatgatcggcggaacggtggtgatcgtcggcttcctgacgctggcagcgggcggcacgctggccatccaggggtacacctcgctgggcaacatcggcatcgaggcgctgaccggctttttggccgcgttcatcaacgtgcgcatcgtggcgccggtggtcgccgggatcgggctggcggccaccttcggcgccggcgtgacggctcagttgggcgccatgcggatcaacgaggaagtcgatgcgttggagagcatggcaattcggccggttgcctacctggtgagcaccaggatcctggccgggatgctggcgatcacgccgttgtacagcatcgccgtgatcctgtcgttcgtggccagtcagttcaccacgaccttcctgctggggcagtcacagggtttgtaccagcactacttcaacacgttcctgaaccccatcgacttgttgtggtccttcctgcaggcgattttgatggcgctgaccatcctgttgatccacacgtactacggctatttcgcttccggcgggccggccggtgtcggcaacgccaccggcaacgcggtgcggacgtcgctcatcgtcgtggtgtcggtgacgctgttggtctcgctgtctatctacggtacgaacggcaacttcaacctttccggttagcagaggaggtgaaacggcagtgacgcagaatgtgccagccggtcgcggcgcgatcgccggtcgacccgcgcggccgggccatgcccacccgcccgcggggcggaattacctgccgcccctgctcggactggccaccatcctcatcatcggcctgatcttcgccgtggcggtgggcctgtttcagggttcgttcactgaaaccgttccggtgacggtgatttcgcaacgagccggtctggtcatgaacccggacgccaaggtcaagatgcgcggcgtgcaggtgggcaaggtcgcctccatcgaatcactgcccaacggccaagcggccattcacctcgcgatggacccgtcgcagatgcacttcatcccgagcaacgtgctggtcgacatcgcgtcgtcgacggtgttcggcgccaagtcgatccaactggtggaacccgcccaaccctcggcccagcggctgcgcgccggtcagacgctgcagggccagcacgtcatggtcgagatcaacacggtgttccaggaattggtgtcggtgctgtcgcacatcgacccgccgaaactcaacgagtctctgggtgcgcttgcccaagcgttcagtgggcgcggcccacagctgggccagtcgctcagcgacctggattcgttcctcgcccggctggagccgagcctttccgcgttccgccatgacctctccgtcctgccgacggtgtcgaacgcctatgccgacgcggcgcccgacctggtgaagaccgcggccaacgcgacccggatcagcaagacactggtcgacgaacagcacaacctggacgcgctgctgatcagcgcgatcggcttggccgacatcggcaatgacgtcttgtcgacgaaccgccaaccgctgacgaacgtgctgcatctactcgtgccgacgaccgatctgaccaacgagtacgggccggcgctcacttgcagtttcggcgggctgataaccatcgcgcacggtccgccgctgtcggaaccgagcatcaacatctcggcgagcctcacctggggcggcgaacgctatcgctacccgacgaacctgcccaaggtcgcggccaccggcggccccaagtgcatgggcctgccgaccctgccgttcaacaccaacccgccgcaattcatcaccgacatcggggccaacccggtgggatacggaaacccgcagctgctgatcaactccgatctgctcaagcagctgttgtacgggccgatcgcgggcccgccccgcaactccgcacaggtggggatgcccggatgagaacacgcgccacactgatcaagttcgccatcttcgcggtcgtgatggcgatgctgaccgccttcctgttcttcatcttcggccagtaccgcacgggtgcgacgaacggctattcggcggtgttcaccgacgtgtcgcggctcaagccggggcagtcggtgcgggtcgccgggatccgggtgggcacggtcaacagcgtttcgttgcagccggacaaaaaggtcgtggtgaagttcgacgccgaccgcaacatcgtcctcaccgagggcacccgggcggcggtccgctacctgaacctggtcggcgatcgctacctggaactggtcgacggtccgggctcgcccaagcggctgccggccggcggtcagattcccgtcagtcgcaccgcgccggcgctcgatctcgacctgctgctcggtgggctcaaacccgttacccagggcctgaatgcgcgcgacgtcaacgcgttgacctcaggactcctgcaggtcttccaggggcagggcggcactctcgactcgctgttcaccaaggcgacgtcgttctcgaatgccctggccgacaacgaccaaaccgtgcagcaactgatcgacaacctcaacatcgtgatcggcacgatctccaaagacggcaaacaattttccggcgcggtcgatcgcctcgagcgtctcgtcagcggactgtccgatgaccgcaacaccatcggttccgccatcgacgccctggaccggggaaccgcctcgctggcggatctgcttgcccaggcgcggccgccgctgaccggaaccatcgatcagttgaatcggctggcgccgattctcgacaacgacaaggaccgcctcgacgcggcaattggcaaggcgcccaagaactatcgcaagctggttcggctcggcgcgaacggcgccaccatcccctactacctatgcatgttggagctgcgcggcacggaccttcagggcaagacggtgcgagctcccatattccgttcagatgctggaaggtgcacggaaccctgatgctcaagtatcgcggatctgggctcgtcaaggccgggctcatcggtgtcgtcctggcggtgatggtgatcctggtgggactgtcgccggaccggttcatcgcgtgggcgaccatggtcaggtaccaggcgctgttcaccgaggccggcggccttgccacgggcaacccggtggtggtgtcgggaatgaaggtcggcaccgtgtcggacgtgaagctgcatcgcggcgacgccctggtgacctttgcgctgaagggcaacatcctgctcgggtcggagaccaccgcgcacatccgcaccgggacgctgctgggtgagcggatgctgacgctggagtccgccggcaccggcaccatgcacccgatggcactgattccggtgtcacgcacgtcgtcgccgtactcgctgaccgaagcggtcagcgacttgaccaccgacaccgccgggacgaacaccacggcgctgaaccagtcgttggacacgctggctgcgacgctcgaccagatcgcaccccagatggggccggccttcgacgcgctcacccgcttgtcgcgaaccctcaacagccgcaacaagaacctcggcgagttgttcaagagcgccggcgatgtcaccggagttctttccgaacgcagccagcaggtcaacaagctcatcctcaactccgacgtgctgctccaagtcctggtggcgcgccggcaggagatcgtggacctgctggccaacacgtcggcggtggccaagcagctgacggcgttggtgcacgacaacgaaagcaagctggcgccgacgctggagagactgaactcggtcaccgcgatgttggaaaagaaccgcgacaacatcagcaaggcgctgccgggcctcaagaaattcgagatcacggtgggcgaggcgatctcgagcatgtacgcctactcggcgttcgtcccgaacttccttgcaccgcaactcttccagccgttcctggactacctgtggggattccgcaccttcgacacggctctcggtccgggccacccctcgccggttcctcggtcgctgattccctggccgtacaacgggattccggtatgccccggctgcacgttgggtggccgggtcggagggtcgcaatgagcccccgggtcccccgcaacaggctggcggcgctggcggccgttgtcctggtcggactcatcgtcgccggcgccgccgtgctcgtccgcaacacgtttttcgggcaaaagacgatcaccgcctacttcaccaccgccaccgcgatttaccccaacgacgaggtgcgggtatcgggtgtcaaggtcggcaacatcaaatccattgagccccaaggcacccaggccaagatgacgctcaaggtcgaccatgacgtgccgattccggcggacgccaaggcggttatcgtcgcctcgaacctggtatccgcccgctacgtgcaactctcgccggcctaccgcgacagcgggccggtcatgcccgacggcgcggtgatacccgtggaacggaccgccgtgccggtcgagtgggacgaggtcaagacccaattgatgaggctggcaacggatttggggcccaagagtggcgtgtcggggacgtcggtgggccggttcatcgacagcgccgccaatgcgctcgacggcaacggcgacaagctccggcagacactggctcaactgtcgggcgtgggccgcatccttgccaacggcagcggcaacatcgtcgacatcatcaaaaacctgcagaccttcgtcggcgcgttgcgcgacagcaacgtccagatcgtgcagttcaacgaccgactggccacgctcaccagcgtcgtcaatgacagcaagtcggaccggacgcggcgctgaccgatctgtcgacggcggtcggcgaggtgcagcgtttcatcgccggaacgcgtaaccagaccagcgagcagattgcccggttggccgatgtcacacagattttggtggatcaccacatggatctggaaaacatcctgcacgcggtgccgaacgcgctgggcaacttcttcaacgactacaacgccgacaccggaaccatcgtcggcgggttcgggatcatgaacttcgcgaacccgacgttctcgggcctcatggttccgctgcccgtgcccggctgcacggcagtcggtgccatcgagaacatcaccgcggtcgaatcgggcaagctgtgctcgctgttcctcgggcccgggttgcgggtgctcaacttcaacaacctgccgattccgatcaatatcttcctgcagaagtcggtggacccgtccaagatcctctacagcgaaccgcgcctcgcccccggcggcgagggcccgaagcccggaccgcccgagatcccgcccgcggtgtcggcctacaccggcctgcccggtgatcccgtgggaccgccgggggcggagccgcccgcgcggataccgggcgcagcgatgccgctgccgccaccgccatcgacaccgatgccgccgccaccgcccccggagccgggcgtgtccggcatgctgctgccggcgcaagggccacaacaatgatcgcccgagtagcggcccgccgggtgttcgccatcggctgttgcgtgatggtgaccgccacgggatgcgcattccacggcctgaattcactaccgttgcccggcgcggtcgggcgcgggccgggggccaacatctaccatgtcgagctcccgaatgtcggcacgatggagtcgaattcgccggtgatgatcgacgacgtcgtggtcggcagcgtcggtcagatgagggtgcagggctggcatgccgacgtcgagatctcggtgaagcgcgacgtcgtcgtcccggccaacgtggtggccaccgtcggccagaccagcctgctggggtcgatgcacgtcgaactcaatacgccgctcggccagcagggcagcgggcggttgcagccgggtgccaccatcccgctcagccggtcgtcggcctacccgtcgaccgagcagacgctgtcgtcgctgggtgcggtcgtcaacgggggagggctgggacagatcggcgagatcatccacaacttctccgccgcgctgtccgggcgcgagggcgcggtgcgtgacctgatcactcgcctcgacacgttcgtcggaacgctggacgatcaacgcgacaacatcgtcgactccatccaggcgctgaaccgcctcgccggcacattcgccgagcaacgcgacgttgtcagccaggcgctgcagaaagtaccgccggcactcgatgtgctgatcaaggagcggccgcgcctgaccgccgccctggacaagctgcgcgtcttcagcaacaccgccacccggttggtcaacgactcccaggccgacctggtgcagaacctcaagaacctggagccgaccatccgcgcgctcgccgacgtcggaccggagttcggcacggcgatcgcggcggggttcgtattcccgttaacccagaacttcgtcgaccgggcggtccgcggcgactacttcaacctgcacgttgatttggacctgtcgatcccacggctcaagcgtggcctgatgttgggaacccactggggccagctggaccagccgctggtgccggagcccggcgacccgtattacctgcaatacacccacgatccgctgcacgacccgctgcggccgccgtgggtcggtccgggacccaggcagatcgtgggtgatccgctgcccgggcctccgccgggcgcggctccgctgccggggcccccgccgggcgcggcaccgctgcccggacctccgcccggcgcggcatcgctgcccgacgcgggtctcggccaaacaccgcctgcggcaacggcaccgacggaaggtggcggatagatgctgacgcgcttcgtccggatccagctggcgatcttcctgatcgccgggaccatcggcgtgatctcgatggtgctcttctacattcaggcgccgaccctgctgggcatcggccggatgacggtgacgctggagttgccggccaccggcggcctgtaccggttttccaacgtgacctaccgcggggttcagctcggtaaggtcaccgcggtggggctgaccccgagcggtgtgaaagcgactctgtcgcttagcacttcaccgaaggtccccgcggacctgaccgcggaggtgctcagcgtgtccgcggtgggtgagcagtacgtggacttgcggccgaggaccaattcaccgccctacctgcacgacggatcggtgatcgccatgcgcgacaccaagattccgcagccggtcgggccaatgctggatcaggtcaatgccctggtccagagcatcccgaagaccaaactcggccaattgctcgacgagtcgttccagggcttcaatggttccggttacgaccttggatcgctgatcgactcctcgcagacgttgtcccgcgacgccaacggcgtcgtcgatcgcacccgcgccctcaccgaagacaccgggccgttgctggatacccaggcacaaaccaccgattcgatcagaacctgggcgcgtagcttcgccggcatctcggatgtgatggtgaacaacgattcccacttccgcaccatcctggaaaagggtcccgagaccgcgaacgaggcgtcgcgactgctcgatcagatcaagccgacgctgccggtgctgctcgccaacctgaccaccatcggtcagatcggcatcacctaccatccttcgctcgagcaactgctggtgttgctgccgtccgcggttgccatcgagcaggctgccgcggccccgaaccatcccgagggcaccgcccagggtgacttcgcgctgacgatcgacgacccgccgatctgcaccgtcggcttcatgcctcccaacacctggcgatccccggacgacctcagtgacatcgacacgccggacgggttgtattgcaaactcccgcaggattcgccgctctcggtccgcggtgcccgcaactatccctgcatggggcacccgggcaagcgggcgcccaccgtcgaaatctgcaacagcgaccagcctttcatgccgctggcgatgaaacagcatgtcctgggtccctacccactggatccgaatctgcttgcccagggcgtcccgcccgatgaccgggtcaccgtcaacgacaggatcttcggacccgtcgaggggacgccgctgccgccgggggccgtgccgcgcggtgcgccggctgggcctcgaggggagaatcccccaccgggttcggtgggggcggccgtgccgccggtgccgtcgtcgggaccaccggcgctggcgcccatgtcgagaatgtcggccgacctgccgcccatagcgccgctcgacgtcccgacgccgacggaacttcccccgccgccaccgccaccaccggcgcccgcggcaccggatcaggtcgacggcgcagcgccccaggccgcgccaagcgcgttcgcaggcaaggcatccaagcccgcgccgtcggtcgtggtggccaaatacgatccgcgcaccggtcgttacgtcgggccggacggaaagctgtatcagcagtcggatttggtgacgccgaaagcgcccaagacatggaaggacatgctgcccacgtaacaccgcgcagcggtcaaggcgccacgcaccaaaagcagtgcagggtaagcgtattggggccgcggtgctcgctcagctcagcttgtccaggcgcagcggcatcgcgatgtcgagccactggttttgcccgcacgcgccgctcgggccgaccgtcttgtcctttccggcgaaggtcgatgacccgagctgatagccgccgtattcgttcaccgggtagaaatagaaggtctgctgcccggtgaacgcggtgccgtcctcgcaccgctcccaattcggcacctcgtgtttcaccttccacatctgcccgtcgctcatataaaggggggcagtccatcccaggtcgctggtcaccgtgccatggcattcctgaaaggtgtcgcacgtcgagctgatcgtccaggtctggacgaccgtcggctcttcgaagtactggtcgttgcgctgggcccagtcgccgatggacgtggcgcggaacgttccgttgacggccacttcttccttggttgtcgcccctgctgtggccgcggcgccgagaccgccgaatgcggtggcagcgaccagcgttgcggtggtgagagttcgaactgaacgcatcaggtgctcctcggcgggaatgaaccgacagtgcctacggcagcttttcggcatcggttgccggcgttctcgcgggctgagaataacaccggagccggcggcgcggaatcgattgagccaaagacggacgcggtcacgacagcggatccaacttcgagatcagccaggaacccttgactttcgtcaacgtcacgcgggcgctgctcgcggtcgtctgcggttcgggcttctgcttgctggtggccgtctggttgatgaacaccagtacgacggccgagtccggatgcaactccgagacggcggcccgcaccaccttcgcggtttcggtgacctgcttctgctgcgccagcgccgcgatctgctcggtgaacttggtgtagtaggcgagaaaatcaccggtgagatacgactgcgccttcgcgaaatcacggttcaagctttcgggcgcataggacagcaccgccgcggcaccgtccgacgccgcttgcactgcccggtgtgccgccgcgtcgccgacgcgctgatccggccggtacagaacgaagtacaggctgacggtgacgccgaccgcgccggcgaccaacgccgtcgcgacgatggaacgccaccgcgccgcgcaccggccggcccagagcttgatggtggcaagcctgccggcgcgagcagatcccgcggacggcgattccgtcttgtcggtggtctccacgtcgtccagcgacgaaccatgctcgacagtcattgcaggaaatcgactttcgacattttgagctggccgccgtcgcgcgtgaggccaacgctgatccgccacacgacgggtggccggttcgtgttgtccgcgttggtgacatcggttttcgccgcgaccagcacgaccgccgagtcgtgactcatcgactcgacgccgacggcttccacggttgccttgctgctggccttcgactcctctgccttttgcaacatgaggcctgacgtcgcttccaattgcttcttgagatcgccggtgcaggcgtcgatgacgcgctggatgtcctccctggcgtgctgggcgttcagcgacatcagcagcacgacatcttgccgggccgcggcggcgtactcgtccgacagctgccggttgtgtgcggcgacccggtgttgccagaccatgtagccgctcgcgccgagcgatgccgaggcgagcaggattccggcgccggcggcgattgccctgcgccccggaaggcggagccagcgcggccgtccggggcgtcgcgggatgcgcagccggccccgggccgacttcgtggcacgctgttcgacgtcttcggcggcggcgtcgtcgccgctggttccggccgctgcgcgcagcctcgacaggcgttcccgcgccgcttcggcgcgcgcctcggccttggcgacttcgtcttcggcgtccacttccggggtgggcgtcgaggcggcgtcgaaccggtcggcgtcagtcccctccggatggtgcacggagaagcagcttatcactcgggcctgagctcgacgccctcgtcggccggcttcccgggcggctctcacatgcggaaatgcgcactgcaccgcgcgtgggacgcactggcgtcggctgcggcacgacggtgacggcgaccggtcccgcgtcatcttctccaagcaggagaattttcttttcaggtgtggcagagtaatcgggtgcgatcaatcgtggccctggttgctgcgttgctctgcgcgggtgtgctggcggcgccaccgtccttggcggggccgactgtgtgcgactaccccgcctgcactccgggcatcatgccgcaccaggttctgggcgctccatgcgataacaccacctattacgtcttcggtgtcgatgacagcgtcgtaccccccggcgcgcagccgggacggctgatgttctgcggctcgccgaggagataccagcccagatggttccggtcaccgccgatggcgggagtcaaggaagaaaacaccgagtgccagaactaccagaactacgtcgcgcaggcgcccgacggtctgttcctggtgtgttatccgcacgacggcatcatgagctggatccgcgccgacacgtagccgcgttactcgatgggcttgcgaggcaggccgagcaggcggcggcttagatcggtgacccggtccagcaatgtctcgtcgtcgatgtcgacgaccagcggatgcatgaccgcggtgctgagcgcgcccgagaacatggcggcctcgatccgcccgtcgagacccgcatcgctcagcagcacccgatacaggcgatccatgaaccgttgaaacggctcgtgctcggccagcaaccggacgaccacgggatcgaactgcagcgtgcgcaccaatcggcgatcacgaaccgccatctcgatcacccgcaccaacaaggcgtcccgggcttgcggcccgtcatcgtgcgcttcggcctcctcgagcgccggcaccagccggcccagttctcgctcggtcacggcgatgacgatctgctccttggttcggaactggtggtagacagcggctttcgtgatgccgaccgcgtcggcgatcatctgcagcgacgtaccgctgacaccgttcgcggcgaacagatccagggcggcgtcgagcacccgcgtccgggcagggctgtgctcgacgagccagaactgctcatcgctgaccgcctgccgtgccgtgcccacgcaccgagactagacgacgactattgaccgaggctagccgatcggctagcttcgctgacgagtcgagtaatggccgacttcgttcgggagggagtaccgatgtccgacgtcgacggtggccacgcgcgggggccgcgccgggtcgacggcgagctgatcctgttctggacactgccggttgccttggtcctgtggatcgcctcgtttttcctctttccgggcttcaatccgccgatgtcaccgtcgctgccggccgaccaggttgccgcgttctaccgcgatccggcccacctgcccgaaatccggtacagcatgatccttttcaactggttcggcgtgtgccttgtcccgatcctgacgctgatcgtgctgcagatccgtcgcatggcgcatcggacgccgatcttctcctacgccatgctcggctgcgcggccggcggcccgaccctgttcctggtcgccaacgtctgctggttgctggctgcgttccggccggaacgcagccccgaactgacccagctgctcaacgacttcggctggatcaccttcaccatcgtggtgccgttcttgatcgggcaaagcgtaatcctagctctggcaatctatttcgatggccagccgcgtccggtgttcccacgttgggtggcccacttcaacctgctggtggccgccgcgctggtgcccgcggccttcgtcggggtgtcgctgaccggcccgctggcgtgggacggcttgctgtcgttctgggtgaagaacgtcgccatcgcggtgtggatcgtcgtgatgggcgtcgttttggggcgggcgatctaccgggagcgcgccgagaacaccggccgtgcaggtgaattggtgagcgcatgagcgccgtgctgactccggcaacgtccacaggcccgctgcatcagcggatcttctggcagctgaggcatggccccaaacgggagctgtggctggcgtggacggtgctcgtcgtcttctacgccgcgttcttcccgatgttcttcatcgtggcgcaggtccagccgccaccacagcccacctgggaccttgccacgcaagcacattggttctccgagcgccgcctcggtatcccgttcggcttcggcgtcatcttcgccatcaccggcatgaccgcggtcaacaacgccctcatcgcgtattccatgcggcgcatgtccgtcagccgtgctttcggctattcgtacctggtcatctactcgctggccgcggtccccggcatgttgctgctgtgcatcgcgctgatcgtcggaacactgcgtcccgagcgcaaccgcgaagtgctcggctggctctacgatttcgccttcctgtctttcgacgggaccatgggggtgttcctgatcggctcgctgatctggatggtcgcgatcctgctcgacaagaaccgggtgttccccaagtggttcggctacctcaacctgtgcaacgcgctgaccgaggtcgtcgtagcgccgtgctggatcttccggcgcagcgtgctggcctgggacggccagatcgcctggtggctggacatggtcgtgttcggcatctaccaggtcactttcatcgtcatgctgttccagatgatccgccgcgaggatttcggcactggcccgctgcccgacgatccggcgcccagggaaaggggcgtgacgtcatgaccgggctggccgagcggcgcgcgacaacccggttcgtgccggggcagccggacatgtgggccttcgtgctgttcgaaaccctggtcttcaccgcgtatttcggtttctacctgttctatcgcgcccgtaaccccgagctgtttctgcactctcaggcgcacctggacctgcggatcggcgtgttcaacaccctggtgctgctgctgagctcgtggtcggtggcgcgctgcgtgcagtcggcgcgggccggtgtctaccgggcggcgctgcgcgacgtgtacatcacggctgccttcgccgcggtgttcctgttcttcaaggtgttcgagtgggcccggctggtgcgcaccggaaacgggttggacagcaacgacttcttcacctactacttctttctcaccggcatccacttcgtgcatctgctgatcgggttcgtcgcgctcggcgtcgtcgtctaccagctgcgcagcccggcccgccgctcgcaggagctcgtcgaaacctgcgcgacctattggcacaccgtcgatttcctgtgggtgctcatcttcgcgttgctgtatgtggtgaggtgagcgtgaaattcaacaagcggttgatgatcgtctggctggtgctgtcggcgctgacgctggcctacctggggatagatcattccgccgggggatcccgcaaggccggcgcggtggtcaccgcgagcgtcatcgtgatcgcactcgtcaaggtgcgcatcatctttcgcgagttcatggaggtgcgcaacgcgccggtgctgctgtgccggctcatcgatgcctgggtggtgatcatggccgcggcgatgctcggctgctacttcatcgggatgaccgtttgattcagcccaccggcgcgacggcgtccgcggtggtgaacgtcaggtgcagttcgctcaacccccgcaagatgtaggtcggctcgtaggtgtagcggcggtcgccggccggaccgtggtgagtttcgttgatctcgatgtgcggcatccggtccaggatgcgctcgatcgacacccgtccctcgacccgcgccagcggcccgccgggacaggagtggacgccacgggcgaacgccatgtgttcgcgaacgttcttgcgccgcaagtcgaattcgtgtgggttctcgaaccggcgcgggtcgcggttggcggccccgggcaggatcatcaccaccgtgccggcggggatgtcgacgccgccgatggtggtcgccctgcgcgccaagcgggaatcgcttttcaccgggctctccatccgcagcgactcctcgatgaatgcggggatgaggctgcggtcctcccgaagctgttgctggatgtcgggccggtcgccgagcacttgcagggccgcgctgagcagcttggcggtggtctcctgaccggcggcgaacaggaacgtcgccgagcggacgacctcgatgaccgggggcgtggatccgtccggatatttcgcctccgccaggaaggtcagcacgtccgcgcgcggctcgcgccgccgctcctcgatgtagttgcagaacttgtcgtcgagccattccagcgggttgatgccgaccgtctcgtggtccagggcgcccacccgcgcgccgggacggtcggcgcccaagacggtgcggaactgggtgtggtcttcctcgggcacgccgagcaggtcggcaatcaccaaggtggcgaacggctttgagtattcggcgatgaactcgcattcaccgttgtgcaggaactcgtcgagctggcggtcggcgaggcgccacatgaactcctcgttttgcttcagccggctcggggtcagcagtttggccagcaccgaacgggccttggtgtgctccggcggatccatggtgaccatgtgctcgaacatcgggaacgaactgcggtgcgcatcgatctgggcgctgatgtcgtcgccttcgggcgtgacgggcagcggcgggaagggcccgccgagggcgacgatgttggagaacgtctccgggtccttgtagacctcggtggcctcttcgtagccggtgatcgcgacgacgccgtagtgcggcagccgcagcaccgggttctggctgcgcaggtagtcgaagtacgggtgcggatctgggaccagcgacggatcggtgaagaagtcgatcgagtcgaaattgctcatcggagtgcgtccccctgggctgggttttaccggtggtgttcggcggcaagccgtaccgccgcccgattgcgagatcgaaaatgtgctgagcacctgcttagcatggcggtaatgtcagggtcaagatcgcaacgccgcgccacgatacgatccgtggggtcggcagggatggcacacagtacggagcagggacatgacatcggcctcttcgggagcctcgtccggggcctcttcgggagcccgcaggatcggggcgccggacgcgaaaaaccgtggtctgctgctcgatgccgccgagcggttgatgctcgaagagggttatgcggcggtgacttcgcggcgccttgcgagccgggcgggattgaaacctcaactggtgcactactacttccgcaccatggaggagttgttcctcgaggttttccgccgccgtgccgaggaaggccttgcggtgcaggcgcaagcgctgcagtccgatcagccgttgtgggcggtgtggcggttcggcacggatcccgccttcacccagatatcgatggaattcatggcgctggccaaccaccgtaaagacatgcgggccgaaatcgcttactacgcagaacgtttccgcgacgaacaacaacgggcggtggccgccgcgctggagcgttacggggtgcagaacaaggacgtgccgccggtggtgtggaccgtgctgatgaccagcctgtcccggttcctggtgctcgaacaggcgatcggcatgtcgagcgggcacgccgaaaccgtgcagctggtcgagagttacctgcgccggctggaaggtgagccgaagccgatcgcgggtgtgccgtcgtcctggacggttcaccagggccggatcgagcagagcacgcccttggggccgtccttggataccacgacggctccgtcgaccgtcagatcgcagtgaagccccggcgtgccgggttcggtgcccgtgctggccacgaccatcgcgtacacctcgggcttggacagatccagctcgtagctccacggcttgcccggcgcgaggtcgacgtcgacgtgcggcgtgaacgaataggggttgcggctgtagtcggcgaaaatggccggctcatggtccaggtaatagatgctggtgtagatcgggttctgtgcggtgacggtgtatttgacgtggtccatgaccggcgggtcgtcggcatgcgcccgtccggcgcccaccagcacacccgatgccactaacagagaagtcagcgacgcgacggacccgacgcccatggccgtcctcggattgatggtcatgacgctcctccggctgccgggcgaggtttggtgttgcgggccatgacccgttccgcggcctgccagtgcgggtcggcaacccatagccgtgcaaaggatgctatcgcctcctcgggagaaaccccgcggattacccgctttatctcggccgccgggcggcgcgccaacgaccgcgcgatcgaccgccagccctgctccgccgagtcgaagacgtcgcgcggcaacacccggtccaccaggccgattcgttcggcctcgaccgcgtcgagcgcggttcccgaaccggccagcagcagcgccctgctctgtccgaccagcgcggccagccgctcagctccgccccaggccggcatgatctccagcgccacttggttgaaggcgatcttgatgtcgtcggccgccacccgaatatcggcggcgacggcgacctcggcgccgccgccgaaggcatggccgttgagggcggcaacgacgggcgcggggaagtcggccagctggtcgcagatggcccgcatccgtcgggccatcgccgcggcatcctcctcggtgcgcagcgcgctcagctccttgagatcaccgccggacacgaaagcgcggtcgccggcgcccgtgatcaccagcgcctgcgcgcccgcggccgcgtcgagcgccttctccagttggtccatggtgtccagcgcgatggcgttgcgcggatgcgggcgatcgatggtgagcaccgccagcccatcgtcgatctcgaggtccaccatgcgttgtcgctccttggcaccggcccgatattggcattctcttttcgcgagaataacatcatcgctgcaggcccaggaactttcatcggcgaggcgggaggtgactcggtgcggaaccgattcgtggcggccggcgcggccctcaccgtcgccctgctgggagcatgcacgtcgcggccgccggcccagctctccagcacggcatcggtgaccgtcgacggcaaggaccgaaacttccacatcgtcacctgccggcagttggagtggagacgcatgatcgacatcggggccgacttctccggcgccaaggtggccgtcgacgaaaacgcgcagccgccggtcgtcgagtccgtgcacatccagaacttgagtggtttcagcggcatgtactcgcggggtggcagcggaagcgccgacatgagcatgacgggagacaagttcaccatcagcggcaccgctgacggctacaagaccgacaaacccagtgaaccggccacggccaccttcaagatcgtcgtgacctgctgacctcgccgaatcgtcgtcccagcgagggccacgttgcggttgggcacctgtagagaatacaattctcgcaaattgcgaaggaggatttcatggggcaactgtctcaccgggaagacgtcccgtttccgatctttgacgcggacaaccatctctacgagccgccggaagcgctgaccaagttcctgcccaaggagtacaaggacttcgtccagtacgtgcagatcaacgggcgcaccaagatcgcgctgcgcggcgtgatcagcaactacattcccaacccgaccttcgaggtcgtcgcccggccgggcgcctgggaggagtacttcaaatacggcaaccccgagggcaaaagcaagcgcgagctgttcggtgagccgatgcgcgcgatcccggccttcttcgagcccggcccgcgcctggagaagatgaacgagctgggcctggaccgcaccctgatgttcccgacgctggccagcctgatcgaggagcggctgcgcgacgacccggtcgccatccacgtcctcatccacgcgctgaaccagtggctcgacgaggtgtggggcttcaactaccagaaccggatcttcactaccccggtcatcaccctgccgatcgtggagaaggcgatcgaggagctggagtgggtggtcaagcggggcgcccgcgccatcctggtccgcccggcgccggtccccggcttccgcgggccccggtcgttcgcgctgcccgagttcgacccgttctgggagcgcgtcgtcgagtacgacgtgctggtcggcatgcactcctccgacagcggctactcccgctacacctccgagtgggacggcgccgaccaggagatgctgccgttccagaccaacgccatgggcatcctcaacgagtggcggccgatccaggactcggtggcgtcgtgggtgatccacggcgcgctctaccgtcacccgaagctgaaggtggcgatcgtcgaggccggttcgaagtggatgacgccgttgctggacgggctggccgaggtcttccggaaagccccagaggccttccccagcgaccccgtcgagatggtcaagaaccgcatccacgtcagcccgttcttcgaggacggcatcgacgacctggtcaacctggtcggcgtggatcaggtcctgtacggctcggactggccgcaccctgaagggctggcggagccgacctactacgtcaacgcgctgtcgcacctgcctgtcgaggaccaggccaagatcatgggcggcaacctcggtcgactcgtcacggtgtgacgcccggccgacgacgatgcagagcgcgaagcgcgatgaggaggagtcggccaacctgaacagtccacggtggcagaccatccccgagatggtcttgagcgcggcggaccgcttcggcgacgcggaagcagtcgtcgacggtccgctgcgcttgactttccagcaggttgtcgagcgaatacgttgcgccgcaggtgctttcgctgagctcggcgtcgaaaagggcgatcgcgtcgcggtgtgggcgcccaattcggccgagtggatcatcgcggcgttcggattgctcaccgcgggcggcgtgctggtgccggtcaacacccggttcaagaccgaggaggccgccgacatcatcgtccgggccagggtcaaggccgtattggtccaaaagggtttcctcggacaggattacgccgcaccggcggggatcccggtcatcgacatcaagtccgacttcctgtccagcggctccccgttctcgcggccggtgaacggcaccgacatctccgacatcatcttcacctccggcacgaccggccgcccgaagggcgccatgatgaaccatcgccagacgctgcggatgtacgacgagtgggcgacgctggcggatctgcgcgagggcgaccgctacctgcagatcaacccctacttccacaccttcggtctgaaggccgggctcatcacgtcgtttctgcgcggcgcgacgatgctgccggtcccggtgttcgacgtcgacacggtggtggatctcattgaacgagaacgcattacgatgcttcccggcccgccgacgttgtaccactcgttgctgaccgtgccggacaagtccaagctggcgacgttgcgggccggcgtgaccggcgccgccgacatccccgtcgaactcgtccgtcgcatccacgacgagctgccgttccagacgctgatgaccggatacggactgaccgaggccggaaacgtgacattgtcgcggcccggcgattccttcgaggacgtggccaccaccgcgggcgtgccgtgcgagggggtcgaggtgcgcatcgccgacgacggcgaggtgctggtgcgcggctacggcgtgatgcagggctacctcgacgatcccgccggcacggccgaggcgatcgacgccgacggctggctgcacaccggggacctgggcaccttcaccgagaccgggcggctgcgcatcgtcgggcgcaagaaggacatgttcatcgtcggcggcttcaacgcctaccccgccgagatcgagggcttcctgctcaaccacccggccgtcgcgcaggccgccgtgatcggcgtgcccgacgaacggatgggccaggtgggcaaggcattcgtggtggcgaacgccgaggtgtccgaaagtgacttgctggcgtggtgtcgagatcggatggcaggattcaaagtgccaaggaccgtcgagtttctcgacgcgttgccgctcaacgccaccgggaaagtcatgaaagaccaactccgttgaacaacggcgatattcattcgatggtgatcgcatccgattaccgggtgccggatccgacccgggtgtggccgctgctggaacgcaacaaggcggcgctcgccgatatcggcgcgcaccacgtgctcgtctacacctcgacgcacgactacggccgggtgctggcgatgatcggcgtgcacagccgggagccgatcgtcgaactgctgcggtcgcgggtgttcttcgactggttcgacgaggccggcgtcgacgacatccccgcggtgttcgccggcgagatcgtcgaccggttcatcacccaaccgccgacgaacccgcgggcgcccggcgtcgtggtggccgcgatcgcctcggtcaacgacgtcaccctgctgacctccgaagtcagttccgccatcgacagattcgcccaagccggcatccggaagacctgggtgttccaggccttcgacgacgaccatgaagtgctgatcctgcaggagttccccgacgaggacagcgcgcgggagtggatcgaccatcccgacgccgcggcccaatggatgtccggggcgggcatcggcgcctacccgcccttgttcgtcggccgcttcttcgacatgatgcgcatcggggcggactgaggatccgccggtgttcgtgtgcctgtgcaacggggtcaccagccagaccgtgaccgaggccgtgcagtgcggcgcgtcgaccaccaacgaagtcgcccgggcatgcggagccggcgccgattgcggccgctgccggcgcaccgtgcaggccatcctgcgatcctcgtccggcaatcgaacgccgaactcgatctagcggcgcgggctgccgtccggtgaggtcggtcgcacgagttcgaccagcagccgcgggatctcgagccgcggcagcaccacctcgaccagcaccatccggtcttggtgccgcgcggcggcggtcaacgcgtcatcgagttcgccgtaggtctgcacccggaacgccaggtgttcggtgacgcccaacgcgttggggacctccgtccacttccacccgacgatgtcgttgtagggcgccgtctcgccgtggatcgcccgctcgacggtgtagccgtcgttgttgaccaccacgatgacgggggaaagcccttcgcgggcaaaggtgccgagctcttggacggtcagctgcgcggcgccgtccccgatcagcagcaccgtccggcggtccgggtgcgccaccgcggcgccgagcgcggcgggcagcgtgtaaccgattgagccccaaagcggttggccgatgaaggtgactccctgcggcaaccggtggtctgccatgccgtagaaggaggtgccctggtcggccagcaccacgttgcccggtgtgagggccgtgcatacccggtcccacaccatcttctgggtcagcggttgctcgcggggtgggggcggcggcagcggctcggccggcggcgaggccaccggcggcgaggagaccccgcgccgtgtgaggatcgcggtcagcgcctgaagcgcttcgcccatctccaacggcgcgaacacctctccggccacactgctttggtactggccgacgtcgatggtccgggccgggtcgatccgctggctgaagaagccgctgaccatgtcggtgaacaccaccccggcggtgaccaatacgggtgcctcttcgatcgcggtgcgcaccgccggcgcgctggccgagcccgcgtagatgcccaggaagttcggtgagctctcatcgagcagactcttgccccacatcagcgtggcgtgcggcaccacgtcggccgccagcagcgcctcgagctccttgatcgcctgcagtcggtgcaccagcaggtcggccagcacggtgatccggtgctcgccgatcagtgccgcggcggcctcggtgaacatcgccagcgcgcgggggctggtgccgccggtgtagcggggcagcgcagcctcgggtggctcggtggggaagcgggccacgtcggtggacagcaggatgtagccgggtcgcttctgctcgcgcacctccgacagcacccggtcgatctctcggcgcgccgtcgcgggcatgagatttgcttgagcgcaagtgatttcgcggctgacccggaagaagtgctcgaagtccccgtcgcccagcgaatggtgcagcgcgcgtctggtgccctgcgcgtctttcgacgggccgccgacgatgtgcaccaccggcacctgctcggcgtaactgcccgccaccgcgttggccgcagacagctcgccgaccccgaatgtcgttaccagcgccgacattccgcgcagccggccgtatccgtctgcggcgtagccggcgttgagctcgttggcgttgccgacccagcgcagcctggggtgggcgacgatgtggtcgaggaactcgaggttgtaatcacccgggacgccgaagatctccgagacgccgagttcggcgaggcggtccaacaggtagtcaccgacggtgtatgcgggttcggtcgcagcatcagtcacaggcacgacggtacgctcggtcgaatcccgtccgggcgcgacgccgtcccagtatcgtgcgagccatggcactgaaagaatcccgcgacatcgtcatcgaagccagtccggaggagattctggacgtcatcgccgatttcgaatcgatgccgcaatggtcggagccgcaccagagcgccgaggtcctggcgaccggccacgacgggcggcccagccaggtcaggatgaaggtcaaggtcgccgggatcaccgacgagcaggtcgtcgcctatacgtgggcggacaacgtggtgagctggacgctggtcagctcgtcgcagcagaaggcgcaggacgggaagtacaccctggtgccgcagggcgacgcgacgctggtcaagttcgagcttgtcgcggacccgaacgtgccgctgccggggttcgtgctcaagcgcgccgtgaagggcaccatcgattccgcgaccaaggcgctgcgtcagcgggtgctcgaggtgaagaaggggaagtagacgcggtgagcagcggagggccgctggccggggtgagggtcatcgaattgggcggcatcggcccggggccacatgcggggatggtgctcgccgatctgggggccgacgtggtgcgggtgcgccggcccggcgtggcggccatgccgtcggaggaccgcgatctgctgcaccgcggcaagcggatcgtcgacctggacgtcaaagcccgaccgcaggcgctgctggacctggccgccaaagccgatgtgctgctggactgtttccgccccggcacctgcgagcgactcggcatcggtcccgacgactgcgcggccgtcaacccgcggctgatcttcgcgcgcatcaccggctgggggcagcacgggccgctggcgcagacggccggccacgacatcaactatctgtcgcagaccggcgtgctgtcggcgctgggccacgccgaccgtccgccgctcccgccgctgaacctggtggccgacttcggcggcggctcgatgctggtgctgctcggcatcaccgccgcgctctacgaacgggaacgctccggccgcgggcaggtgatcgacgcggcgatggtggacggggtcagcctgctggcccagatgatgtggacgatgaagtccactggcgcactgcgcgaccggcgcgaatctttcctgctcgacggcggcgccccgttctacggctgctacgagaccgccgacggcaagtacgtcgccgtcggcgccatcgagccgcaattcttcgcggcgttgctcgacgggctcggcctgtcaccggaggaggtgcccggccagcttgaccgggattcctacccacggatgcgcgaggtcttcacccagcggttcgccgcccgaacccgtgatgaatgggcgcgagtgttcgccggcacagacgcgtgcgtcaccccggtgctgacctggagtgaggcggccgcgagcgagcacctgcgggcgcggtccacggtgatcaccgcccacggcgtcgaccaggccgcgcccgccccacgcttttcgcacacccccgcccggccggtcgggcgaccgcccgcgacaaccacgccgctggacgaaatcaactggtagagcgccggttacgtcgaaccgttccgcaccggcagcggcgttgctaagttcatctcagtggccgtaaaagcatcacgcgaattcgtcgtcaacgcgccgccagaagtggtcatggaggcgctgacagatgtcggcgtcctgtcgtcgtggtcaccgctgcacaaacacatcgaggtgatcgaccgctatcccgacggccggccgcaccacgtcaagaccaccatcaagatcctggggctggtcgacaaggagatcctggaatatcactggggtcccgactgggtggtctacgacgccaaaggcacctcgcagcaacacggtcagcacgtcgagtacaacctcaaacccgagggcgtcggccagacccgggtccgcttcgacgtcaccgtcgaacccggccgccccatgcccgcgttcatcgtcaggcgggcgagcgagaacgtcctcgacgccgcaatgaagggattgcaggaattggtgatgcgcgccaaggatttgagggattcgggggaggcggaatagtcggccgtggccgtgcaagcgtcgtcggaaatcgtcatcgacgcgcctccggaggtgatcatggaggcgctcgccgacatggacgcggtgccgtcgtggtcgtcggtgcacaagcgggtcgaggtcatcgacaagcatcccgacggcaggccgcaccacgtgcgggtcacgatcgcggtggtcggaatccatgacaccgaactgctcgaataccactggggccccgactggatggtgtgggacgccgacaggacggcccagcaacacggtcagcacggcgagtacaacctgagccggctcggcgacgacaagacccgggtgcgcttcaccatcacggtcgaaccgtgggtgccgctaccggagttctgggtcaggcgggcccgcaagaagatcctgcacgccgcgctggaggggctgcgcaagcgggtgatgacgccggaggcgttcggccgggctgactgacttagccggcgccgcgcagcgcggccagccgccggatcgcctcgtcgagggtgtcgtcgcgtttacagaaggtgaagcgcaccaagtgattccacacgtcggccggcccgtgcgccccggccgggtcgcagaacggcgacaacgggatcgcggcgacccccaccttctccggcagcgccgcgcagaacgccacgctgtcgtcgtagcccagcgggcgcggatcggcgcacaggaaataggtgccggcactgtcgtgcacctcgaacccgatgtcgatcagcccggccgccagccggtcccggcgggcccgcagacggtcgcgcagatcagccacccaggcgtcctgcgtctccaacgccaacgccaccgccggctggaacggcgcacccccgacatagctcaggtactgcttggcggcgcgcactccggcgatgagatgtgctgggccgcaagcccatccgatcttccagccggtgcagttgaacatcttggccgcgctggagatggtgatcgtgcgctcggccatgccgtcgaagccggccagcggcagatgccggtggtcgtcgaagaccaaatgctcgtacacctcgtcggtgatcaccagcaggtcggactccaccgcgacctcggcgatggccgccagttcggtggcaccgagcaccgtgccggtcggattgtgcggcgagttgacgatcagcgcgcgggtgcgcggcgtcaccgcccgccgcagtgcgtcggcgtccagggcgaagccgcggccgtgggggaccagcggcaccgcgacccgctgggcggaggccatcgcgatcaccggcgagtaggagtcgtagaacggctcgatgagcaggacctcggagccgggttcgaccaggccgatcaccgccgaggcgatcgcctcggtggccccgaccgtcaccagcacctcggtgtcggggtcgtactcgatgccgtagcggcggtgtcgctgggccgcgatggcatgccgcagcggggcgatcccgatcccgggcgggtattggttgacgccgtcggcgatcgcctcctgggcggccttgagcatctccgcgggcccgtcctcgtcgggaaagccctgaccgaggttcaccgcccccgcccgcgcggccagcgccgacatctcggcgaacaccgtggtggcgtacgggcgcagtcgcgagaccgtcatggtggtcgagcttaggcccggcgcgtcgccgccccgccgcttccccggcgagcgtctctccccggcgagcgtctctccccggcgagcgtgaagttagtttcacgttcggcgccgagcgtgaaattagtttcacgctcggcgggaaagagccccagcgggccggcgcctgggcctcggcgggaaagagccaaggcctcgctgacctgcgcggaagtgcccacccaacaggttggacgggggccctgttagggtggggccggaaccttgtcttgaagacggattcgcaccctattcgccagaacaggccagaacaggaagtcgtcatgtccgaagaagcttttatctacgaagccatccgcacaccgcggggcaagcagaagaacggctcgctgaccgaggtgaagccgctcaacctggtggtaggcctggtcgacgagctgcgccggcgctaccccgacctggacgagagcctgatcagcgacatgatcctgggtgtcgtgtccccggtcggcgaccagggtggcgacatcgcccgcaccgcggtgctggccgccggcctgcccgagaccaccggcggcgtgcagctcaaccggttctgcgcctcgggcctcgaggccgtcaacaccgccgcccagaaggtgcgctccggctgggacgacctggtgctggccggcggtgtggagtcgatgagccgggtcccgatgggctccgacggcggcgcctgggccaccgacccggagaccaactaccggatcggcttcgtgccgcagggcatcggcgccgatttgatcgccaccctcgagggcttctcccgcgaggacgtcgacgcctacgcgctgcgcagccagcagaaggccgccgcggcctggtcgggcggctacttcgccaagtcggtggtgccggtgcgtgaccagaacggtctggtcatcctcgaccacgacgagcacatgcggcccgacaccacgatggagggcctggccaagctgaagaccgcgttcgacggtgtcggcgagatgggcggcttcgacgacgtggcgctgcagaagtaccactgggtcgagaagatcaaccacgtccacaccggcggcaacagctcgggcatcgtcgacggcgccgcgctggtgctggtcggcagcgaaaaggccggcaagtcgcaggggttgaccccgcgggcccgcatcgtggccaccgcgaccagcggctcggacccggtcatcatgctcaccggccccaccccggccacccgcaaggtgctcgaccgggccggcctgacgatcgacgacatcgatctgttcgaactgaacgaggcgttcgcgtcggtggtgctgaagttccagaaagacctcaacattcccgacgagaagctcaacgtcaacggcggcgccatcgcgatgggccacccgctgggcgccaccggcgccatgatcaccggcaccatggtcgacgagctcgagcgccgcaacgcgcgtcgcgccctgatcacgctgtgcatcggcggcggcatgggtgtcgccaccatcatcgagagggtttaagaccatggcagagaacaccatcaagtgggacaaggacgccgacggcattgtcacgctgacgctcgacgacccgaccgggtcggccaacgtgatgaacgagcactacaaggaatcgatgcacaacgccgtcgaacgccttgtggcagagaaggattcgatcaccggtgtggtgatcaccagcgccaaaaagacgttcttcgccggcggtgacctcaagagcatgatcaacctcggcccggagaacgccggtgaggcgttcgacaccgtcgaggccgtcaagcgcgacctgcgcgcgctggagacgctcggcaagccggtggtggccgccatcaacggcgcggcgctgggcggcgggctggagatcgcgctggcctgtcaccaccggatcgccgcggacatcaaggggctggtcgtcggcctgcccgaggtgaccctgggcctgctgcccggcggcggcggggtgacccgcaccgtgcggatgttcggcatccagaacgcgttcatgaacatcctgagccagggcacccggttcaagccggacaaggccaaggagatcggcctggtcgacgagctggtcggcagcgtcgaggaactggtgcccgccgccaaggcgtggatcaaggccaaccccgacgcccacgaacagccttgggacaaaaagggttacaagatgcctggcggcaccccgtccagccccgcgctggccggcatcctgccgtcgtttccggcgctgctcaagaagcagctcaagggcgccccgatgcccgcaccgcgtgccatcctggacgcggccgtcgagggcgctcaggtggacttcgacaccgccagccgcatcgagagccgctacttcacccagctggtcaccggccaggtcgccaagaacatgatccaggcgttcttcttcgacctccagcacatcaacggcggcggctcccgccccgagggcatcgagccggtcaagatcaacaagatcggtgtgctcggcgcgggcatgatgggcgccggcatcgcctacgtctcggccaaggccggcttcgacgtggtgctcaaggacgtcagcctcgaggccgcccagaagggcaagggctactcggaaaagcttgaggccaaagcacttcagcggggcaagaccaccgaggagaagagcaagtcgctgctggaccgcatcaccccgacggccgacgccgccgacttcaagggcgtcgacttcgtgatcgaggcggtgttcgagaaccaggaactcaagcacaaggtcttccaggagatcgaggacatcgtcgagcccaacgcgctgctcggctccaacacctcgacgctgccgatcaccggtctggccaccggcgtcaagcggcaggaggacttcatcgggatccacttcttctccccggtcgacaagatgccgctggtcgaaatcatcaagggcgagaagacttccgacgaggcgctggcccgcgtgttcgactacacgctggccagcggcaagaccccgatcgtggtcaacgacagccgcggcttcttcaccagccgcgtcatcggcaccttcgtcaacgaggcgctggccatgctcggtgagggcgtggcgccggccagcatcgagcacgccggctcgcaagccggctacccggcgccgccgctgcagctgtccgacgagctcaacctggagctgatgcacaagatcgccgtcgccacccgcaagggcatcgaggacgccggcggcacctacgagccgcaccctgccgaggcggtcgtcgagaagatgatcgaaatcggccggccgtcgcggttgaagggcgccggcttctacgagtacgtggacggcaagcgcacccgcttgtggcccggcctgcaggagacgttcaactccggcagcaccagtattccgttgcaggacatgatcgatcggatgctgttcgccgaggcgctggagacgcagaagtgcctggacgagggggtgctcacctccaccgccgacgcgaacatcggctcgatcatgggcatcggcttcccgccgtacaccggtggtagcgcgcagttcatcgtcggctacgagggtgcacacgggatcggcaaggaggccttcgtggcccgggccaaggagctggccgcccgctacggcgaccgcttcctgccgccggcgtcgctcaccagctagcgcatcacctagcgcgaaaagacgcgaaagtcccccaaaacccggcattttgggggactttcgcgtctgctcgccggctaccggcgctggaacaggtagtagcgcgccggggtcctctcggcgccgtccagctcgcgttcgggcccggccgccagcagtgtccagtcggccgtgaaccggcgttgcatttcggcgtcctcgacgccgcgcaccccgaaccgcccgcccggcacgaacgcgacgatcagcagccgggcctgcggcgcggccaccccggtgacctcccggacataggcgtcgcggtcggcgtcgctcatgttgtgcaggcagccgttgtccacgatcaattcgaagcccgtgccgatgccggcctggcccagccgcgtcacgtcggcctgcacgaagtcgaccgcggctccggccgcgccggccttggcccgcgcccgctcgaggggcttggcgacgaagtcgacggcggtgacgttccagccgtgctgggccagatagatcgcgcagtcaccggtgccgcacccgatttccagggccttcccggcgggaagggccgcggcgtcgccggtgccctcgaccagatcacgcaggctctgcgccagcggatgaccgtcccacggggtgaagccgatgcggtaaaagatccggaacagcgtctgtttggaagccatagcccaccctaggcccgatcggcacggccggtcatcggctgtccggaagttatcgggaggcggcggcgatgcggcgccattcctcccgcgggaatgccctcgggtcggccagcagcacctggacgcagacatggtcggcgccggccgaacgatgctcggccacccggcgcatgacggcctcttcatcgccccaggcgatgatcgcgttgaagagccgatcgctcacctgggacagatcgtcttcggagaatccgctgcgcagcaggttgttggcgtagttgggcagcgccaaataggcgcgcagccaatcggttccgatccggcgcgcctcgtcggcgctgtcggtcaggatcaccgtctgttccggcagcagcagcgggccgtgccccaaagtcgcacgggcggaagcggtgtggtcgggggtgaccaggtaggggtgggccccaccggcccggctggcggacagcttcagcatcttcgggccgagggcggccagcacccgccgctcgatgggaacgggtcgcggcgccccgtccaatccgtccaggaacctcgccgtggcggccagcggtttgcggtagcgccccggctggccggcatcgatcagcggtgcgtggctgacgccgattcccagcaggaagcggtctccgtgctcggcggtcagcgcggcgtaggactcggcgacctcggccggcgagtgcatccacaggttcaggatcccggtggcgatcactgtccgcttggtggcctccagcagatggcccaccgcatcgaacaccggcccgccgacatcgggtatccatagcgccgggaagcccagttcgtcgagttccgccgcggcgtcggcggattcggcgggatcgccgtagcgcagctggctgctccagattccaacaccggtcagttccacgagcggtcacctttcgtcgcacaccatgttgtcagacgtcgctgtcggcgtagtcgggcaccggcatcgaatcgtgcatccggacgcccttggtgttgagcttggccagcgcccgggccaacgacgtcggcatcgccgagaccagttgggcgccacgggttaacgcccacaccccggcgcgggaaccgggaatgacgccgcgggcggcggcgcgggcaaaggatcggctgcgccgcaccgattcgcgcatctgcagttcgtaggcggcgaaggcgcgcaggtggtcgccgtcggcccgggcgagctcgcccgccagcacgtaggcgcccagcacggccaggctggtgctgccgcccaccgcggggcccgggcagtatccggcgtcgcccaccagggtgacccgccggcgcgaccaccggtcggtgcgcagttgggtgatcgagtcgaagtagaaggtcggggtgcgttcggtttcggccagccagccgtccacctcgtcgtgcatccccgcgaacgcctcgcgcagcaactccttctgccgcgccgtatcgcggtggtcgtaggccaattccgctgcgctgcggaacaagaacaccgcccgggcgtcgtccagatgatcggcggtgtagatcccggcgaaccggccgacaccgacgtggccgaccatctcgccgggcccgaccagcgtcttgggcgccgacaccaccgacaggtagccgcccaggaagcgcgtcaggccggcctcgtcgccgaaggtcaggcggcggacgttggagtgcagcccgtcggcgcccacgatgacgtcgaatgtgcgtggcgcgcaatgctcgaacgtcacggtcccgtcgggctcgatggcggtgatcgagtcgccgaacagatactcgacgtcgtcgcgggcggcgtcgtaatagacctcgctgaggtcgtcgcgcatgatctccacgtgccggtccgaactggccgcgtagatcttggtaaggtcgatccggctgggctggggccggccctcgcgatacagcgtcagccgggtcgttccggtggccaggtcctcgatgcggggcaggacgcccatcttcgccgagatctccatggcggggcggaacaggtcgacggcatggccgccggtcttgcgcagcgtgggcgcgcgctcgacgacggtgacctcgaagccgtaacgggtcagccagtaggccagcaccgggccggcgatgctggcgcccgagatgagtatccgcatggccacctcccggatttacttaacgttaggtaagcctagcatccggtttacttatcggtaagtcagttaagctggtggggtgggcaggccccggtcggacacccgagagcgcatccaacaggtcgctcgagaactgttttcccaacgcggggtgcagcgcaccagcctgcaggacatcgccgaccggctgggcatcaccaaacccgcgctgtactaccactttccgtcccgcgaggacctggtgcgcagcatcctggtgccgctgatcgaggagggcgagcggttcgtcgccgagcatgagagccgcgagcacaccgaggcgcgcgagttgctggagggctatttcgacttccactaccggcaccgccgcgacctggtgctgctgttgaccgagttgtccacgctgatcgacctcgacctgatcgacaccgtgctggcgtggcgggaacggctggccacgctggtgttcggcaaaaggcccacgctcgcccaatccacgcgcgccgtcgtcgcgttcggcgggttacaggactgctgcgtgcagttccccgacgcgccgcaggccgagctgcgcgacaagtcggtcgccgccgcgcttgacgcgctgggtgtccggccccggcggtgaaaaccgttgcggtgcggccggtgcggctagagtcccggggtatgcgctttggtctcttcattccgcagggctggcgaatggatctggtcggcatcgaacccgacgagcactgggcggtgatgcgcgacctggcgcagcgcgcggatcgggacgccggctgggattcgctgtgggtctacgaccatttccacaccgtcccggtgcccaccggagaagccacccacgaggcgtggtcgctgatggccgcctacgcggcggtcacctcgcggatcaaactcggccagatgtgcacggcgatgagctatcgcaacccggtctacctcgccaaggtcgccgcgacggccgacatcatctccggcggccggatccagatgggcatcggcgccggctggtacgaacacgaatggcgcgcctacggttacggattcccctcggcgggtgtgcgattgggccggctggacgaaggcgtgcagatcatgcgcgacgcctggcgcgacggcaaggtcagcttcaacggcaggcactaccaggtcgacggcgcgatcgtcgcgcctaaaccgctgcaggacaacgggattccgctgtggatcgccggcggcggggagaaggtgacgctgcgcatcgccgcggaatacgcgcagtacaccaacttcacgcccgagccggcggcgttcgcccacaagtccgaggtgctggcagcgcattgccgcgacgtgggcaccgacttcgacgccatcgtgcgttcggtcaacgtcaacgccgtcgtcggcgcctcgcgcgccgacgacgacgaccggctgcgacggatccgcgaccgcatggccggctacgtgggcgagtccgccgccgatgcgatgatcgccggcaccagcggcgcggactcggcgacgggcaccaccgaacgggtcatcgagcggctggccaggctccgcgacctgggctgcgactacgtcatctgctacttccccgaggccgcctacgaccgttccggcatcgagctgttcgagcgggagatcattcccgcgctgagctgaccgtccggccgcgacgcggcggggtcagatatccgaggtgacgtagcgggtcttgactgggggcgcggccagcagcggcggaagctgcgtcagcttgccctcgccggcgcgaaacgcgcggtaggcctggtcgtgttcgacggtctcccagatctcgtagacgagccagtgcgcctcgtcgtcctcgtcgaccagcacgtcggtgcggacgttgccgtcgaacgcccgggtgtcctgcagcgcccggcccatcagctcgcgccccgcggcgacctcgtcgggcttgaacctgagctcgagtatcacggtgaccgtcatggcgccaacatatcgctgcgccgcgacggcccgtcggacggctgacgggaaccctcaggagaatgaggtttccacttttcggaaagctgttatacggttcggtgagcaagctttgttggcggattcgtgcacgatcctggaggacccctcgatgcagaaggcgctcgcccccgagatctctacctggcccgacgagagcccgcagctgatcggcagccggtgcgacagctgcgcggccaccaccttcccggtgcagcagtggtgcccgcggtgcagctccggcgagatgtccgaggtgttgttgccgcgccgcgggacgctggtggcctggaccacccagggcttcccgccgggcgccccctatgcgggcccgaccggcaaggacttcgtgccgttcggcgtcggcctggtccagctcggtgacgtcattcgcgtcgagggtcggctgaccgagaacgacccggccaagctgaagttcggccaggaggtcgagctcaccatggtgccgctgaccaccgacgacgacggcaacgaggtcctgacgttcgcgttccagccggtataaggagtcctgagatgaccaacgacgtcgccatcatcggcgtgggcctgcacccgttcggcaggttcgacaagaccgcgatgcagatgggggccgaggccgtccagctggccctcgcggatgccggcgtggcctggaaggacatccagttcgggttcggcggcagctacgaagtgtccaaccccgacgcggtgacccggctggtcggactgaccggcatcacgttcaccaacgtcttcaacgcgtgcgccgccgcggccagcgccatccagcagaccgccgacaccatccggctgggcaagtacgacctgggcatcgcgatcggcctggacaagcatccgcgcggcgccttcaccgacgaccccgccaagctggcgctgccgcagtggtacgccaacaacgggcagttcgtcaccaccaagttcttcgggatgaaggccaacaagtacatccacgaccacaacatctcgcaggagacgttggcgcgggtggccaacaagaatttccgcaacggcgcgttgaacccgaatgcgttccgccgcaaggagattcccgtcgatgagatcctcaactcggccgtgctcaactacccgttgacgcagtacatgttctgcgcgcccgacgagggggccgccgcggtgatcatgtgccgcgcggacctggcgcacaagttcaccgacaagccggtgtacgtgcgcgcctgcgagattcggacccggcgctacggcgcctacgaggtacacgccacgtcggcgccgctggacgaggacgcctcgccgacggtgtacgccgccagggcggcctacgaggcggccgggatcggacccgaggacgtcgacgtcgcgcagttgcaggacaccgacgccggcgccgaggtgatccacatggccgagaccggtttatgcgcggacggcgagcaggagaagctgctggccgacggcgccaccgagatccacggctcgatgccggtcaacaccgatggcgggctgatcgccaacggcgagccgatcggcgcgtcggggctgcggcaggtgcacgaactggtgcgccagttgcgcggtgaagcgggggagcgtcaggtgcccggcaacccgcgcgtcggcctggcccaggtgtacggcgcacccggcaccgcctcggcgaccatcctgtcgctctgaaccgcctgcccggtcgtccacgagcgtgcagccactgcgaaaaatcggcgaaaatctcgcgctcagtgcacgttcggcggtaagggattaaatcgccgggcccagcaggtcgtcggcgtcgcggatgatgtagccgtagccctgctcggccaggaagcgctgccggtgcgcggcgtactcggcgtccaggctgtcgcgcgccaccaccgaatagaagacggcgccgccgccgtcggacttgggccgcaacagccggcccagccgctgcgcctcctcctggcgtgacccgaaggtgccggaaacctgcaccgccacagcggcttccggcaggtcgatggagaagttggcgaccttggacaccaccagggtgttcacctcgccgcggcgaaaggcgtcgaagagctcttcgcgttccttggtccgggtggatccctggatcaccggggcgcccagctgctcaccgagctcgtcgagctgatcgaggtacgcgccgatcaccagggtctgttcacccggatgcttgtccaggatcgatttcaccacagcgattttcgtgtgcaccgtcgagcacagccggtagcgctcctcgggttcggcggtggcgtacatcatccgctcgttgtcggtcatggtgacccgcacctcgacgcattcggccggcgcgatccagccctgcgcctcgatgtccttccacggcgcgtcgtaacgcttcggcccgatcagggagaacacgtcgccctcccggccgtcctcgcggaccagggtggcggtcagccccaggcgccgcttggactgcagatcggcggtcatccggaacaccggcgccggcaacaggtgcacctcgtcgtagatgatcaggccccagtcgcggctgtcgaacagctccagatgccggtactcgcccctggtgcggcgggtgatcatctggtaggtcgagatggtgaccgggcgaatctccttgcgctcgcccgagtattcgccgatctcgtcctcggtcagcgaggtgcgggccaccagctcgcgcttccattgccgcgccgcgacgatgttggtcaccaggatcagcgtcgtcgcgccggctttggccatcgccgccgccccgaccagcgtcttgccggcgccgcagggcagcaccaccaccccggagccgccggaccagaacgagtcggcggccatctgctggtagtcgcgcagctgccagccgtcctcggtcaggctgatcggatgcgcctcgccgtcgacgtagcccgcgagatcctctgcgggccaaccgattttgagcagcatctgcttgacgcggccgcgttcgctgggatgcacgacgacggtgtcgtcgtcgatgcgggcgccgagcatcggggcgatcttcttgttgcgcagcacctcctcgagcaccgcgcggtccaggctcaccagggtcaggccgtgcgcggggttcttcaccagctgcagccggccgtagcgggccatggtgtcgacgatgtcgaccagcagcggctggggcaccgcgtagcgggagaagctgaccagcgcgtcgaccacctgttcggcgtcgtggccggcggcccgcgcgttccacagcgccagcggggtgatccggtaggtgtgcacgtgctcgggtgcgcgttccagctcggcgaacggcgcgatggcggcccgcgccgcgccggcgagttcgtggtccacttcgagcagtaccgtcttgtccgactgcacgatcaacggtccgtcagacatgttcggcgccgctcctcctcatcgttggctctgctggtcattatcggccggtggccgacaccaccgacgtgatgcggtggatggcgaagtcgcgcagccgtccggacgcggaatcgaaggccaccagctggccgccccggacgctgatcggcgacaccacccgctgggtggccacgcccgccgcgtctagataaccgatcaccagggtgtcttgttccttggcggcgcgctgcagcagggtcatggtcaacgccgggtcgacgcggacgttgccgaacggtgcggcggtgacccggcgcagcaccgcgaccaccgcgtgcaggctctcggtgttgggccggcgcacgggccggtaggcccggcgctgctgcggcgtggccacccgggcgccgcgcggacgcacgtccacgatggcgccggtagagtcctcggccgccggggcgaagccggcggcccgcaacgcggccagcacctcgccgatgggcgccggcgataccgcgacggtgggggccagggtgcgcagcgccacgtcctcggtcgcgggggccgccaccacctgggccagcagcgccgggtcctcgcagcgcacgaacgaggccgccatgccgatccgcagctgcccgtgccggcgcgcgacgtcgtcgatgaggtaggtaagcccttggggcaccggtgttttcgaatagtcggcgaagaaggcgtgcatccagtcgcgggtcttgccgatgtcgagggcatgccggatcgactgctcgctgacccggtagaccatcgccgcgccggccgattcgacggtggccacggtggcgagttcctcggccagatcccgctgcagcggcccgggcacgacgacggtcagatccgcctgcaccaggaagtggtcgaccggcttgggcagcgcccgggccatcgcgtcgatcgcggcctgggggtcggcgtcctcgtccaccagcgcccgggcgggggtgctgatcgccccgcgcccgaccaggcccagggcgtgggcttcgcggagcaggtccgcgatgggttcgggctgcaaccgcttggcccagcggggccgtcgccagatcagcgccgccgacgccgaggtcgcgtccacgccggcgccgggcggcagctcggacagcatgccgagcagcagccgccggtccagcggggcggccgtggagtacagggcgtcggtgagcgccccgtagggtttgccgtccggcccgcgaccgccgatcagggccggccggccgggcaggtcgagccagctgccagccagcagctgccagcgctcggcggtcgacagcgcggcgaagcggtcggcggccgtcgtcggcgcccagtacggcgcctcgccggtggcaggttcggggtcgggcattccgctggcgatcagccctgccgcggccgccacttccaggatcaggcccagccgttgctcgtcaatgccggtcgtcttgctgagccgcttgacctcgcgaaccccgagcccaccgctgcgcagctcggaaaccggtgccgcggacagtgtttccagcagcacgtcgagctcgcgcagcaggtcgatgaccgcgccggcggccgccgcgtcggcgtcctcggccgtcgtggtcgacaccaccgggtcgggcgcactcagttgcagggggccgggctgctcgccgcgcagcacctgccccacgtggcggggcaggatcaccgtctcggcgtcgaggcgccgcagcaaccccatggccagcagctggggcaccggccggtcggcgggtgcgcccggcgcagcatcgcgggtgcggcccatcggggagccctcgagaagtttctccagcacgtcgagctgcgccgggtcgaggtcatcgatcagcgccgcgatctgctcggcgctgcgcgaggagtcctcgaggatgacctggcccggatgccacggcatgccgctgcccgcgtccgcggcgacctgcagcgcgccgtcgccccacaccaggacgcgctgccgcaggtcgtcgagcgcgtcgaggatctcggtttcggcggcgcgctcgccgatcagcgccagcagcttggcggtgggcaccggctggacgtcggcctgcaacacgagcagcgcgtcgagcaccgccagccgcaggaagtcgaggtcgtcggtggcggccttgatcgactggcgggcctgggctcgcgcggccagtgcggcgatgctgccgggcggcagctgggccaggtccggccgcaattccagcagtcggatcagccgctcgtcggacaactcggccagccacgaccccagcgggataccgggggtgttgtcggtcattgctgaccagcgtaaagcaggtgacgggtggccagcagacctccgcgcgcgccaggccgacacctgttgggaaccccgaacctgcggtcttgcggcgacgttgccaggccacctgtcagaatggaacccgtggctgacattgctgagggcaaagcacgcaagaacaggtatgtcgacaacggctggccgaccaccgaccccgacgaccacgcggtcagtgaactcgtgaccgaccggaccggcgcgctgtcgccgttcggcgagctggtgttcccgctgcccgccaccgagctgccctacctgcacccggtcaccgtcgtcaatcggtaggtcgccggatggccagggcccctgaggcctcgacagcctcggcgacccgggcgtcgggagaaccccgctcgggtgccctgtcacacctggacgagcggggggccgcgcacatggtcgacgtcagcgggaaggcgcccagcaagcgcaccgccgtcgccgccggggtgctgcgcacctcggcggacgtggtggcgctgatctcgaccggcgggctgcccaagggtgacgcgctggccaccgcgcgggtggcgggcatccaggccgccaagcgcaccagcgacctgatcccgctgtgccatcagctggcgctcaccggggtcgacgtcgacttcgccgtgggcgagtcggacatcgagatcaccgcgacggtggccagcaccgaccgcaccggcgtggagatggaggcgctgaccgcggtcagcgtggcgggcctgacgctctacgacatgatcaaagcggtcgacccggccgcgcgcatcgacgacgttcgagtgctccgcaaggaaggcggcaaaaccggaatgtggacacggtcatgaccacccgatcggcccgcgtcatcatcgcctccacgcgtgcgtcgtccggagagtacgaggaccgctgcgggccgatcatcaccgaatggcttgcccagcaaggattttcgtcggcgcagccggaggtggtcgccgatgggtcgccggtcggtgaggcgctgcgcaaggccatcgacgacgacgtcgacgtcatcctcacctccggcggcaccggcatcgcgcccaccgacagcaccccggatcagaccgtggccgtcgtcgattacctgattcccggcctggccgaagcgatccgccgatcgggtctgccgaaggtgccgacgtcggtgttgtcccgcggtgtgtgcggggtggccgggcagaccctgatcgtcaacctgccgggttcgccgggcggggtgcgcgacggcctgggcgtgctcgccggtgtgctcgaccacgccctcgaccagctcgccggtaaagatcacccgcgatgacgctcgtcgtgcgcgccgccgtgaccgagcacccgatcgtgctggcccagcacgaggaactggtcggccatcagtcggccggggcggtcgtcgggttcgtcgggatgatccgcgaccacgacggcgggcggcgggtggttcggctggagtactccgcgcatccgagtgccggcgaggtcatggccgaggtggtggccgaggtggcggagcggtcctgcggggtgcgggccgtcgccgccagccatcggatcggtgtgctcagcatcggcgaggcggcgctggtggccgccgtggccgccgaccaccggcaggccgcattcgacacctgtgcacagctggtggacaccgtcaaggcgcgattgccggtgtggaagcaccagttcttcgccgacggcaccgacgaatgggtgggctcggcctgagacctggatgcgccgtgcccaacacgccccgacaggagggttttcggggcgtgtggggaatccggtggggttagggcgtcaggcgctgggtgcgggctgcaccagggcgtcgagcgcgtcgttgccctgaacgtcttgggcgcgaatcgcttcccacagtcgctgggtgtaaccggcttccgagacgtggtcgggcatgccggccggcacgaaaccgtggaagtcgccgtccggggccggtgcgtccgccggcggtgcgggtggtgtggcgtcggccgggggcgcgggcggcaggtcggcgggagccggcggcggtgcgtcgggcgccggcgcgtccggaggtgccggccggtcgaaggaggccagctgcaccggggccggcgggggcgcgtccgcgggcggggcctgcgggacgccgttgacaccgggtgcgtccagaccggccggggcgggcacgtcgcgcggggtcgggccggacagcggccccccgcacaccggccacgcgccgcggccctgggtggccagcacccgctcggcgaccgcgatctgttgctcccgggtggccagctcggccgacggcgcgtactcgccgccgccgtgcgcggcccaggtgctcgcgctgaactgcacaccgccgtggtagccgttgccggtgttgatgccccagttgccgccggactcgcagcgggctacctgatcccattcgccgtcggtggccgcggccgcctggccggccatggcgatggcgccgccaccaagcactgcgccggtaacggcaatcttggcgacgctgacactggaagtggtgggcttacggtgacgtccactcatacgcgccgatgtattcctctctcgtcacgcgcctgcgaggtcagctgtcgggttcgggttggagaggccacccggccggcgtggtcgtcgaagcgacgacgtcggcttcacccctaggagccgcgggcggctccagtccgatcacggtggaccggtgggtcccccgtctccatccatgtggttcggttgcccccgcctattggatggagctcggcgcgatagggaggggaggtccgccaatcgggatggctggcgagccttcggagacgttaacggtttctgttggtctcgtcacgtctggcgaaacccggcgtttccctcgcagccatctgcgaaaaccgcaggaacacaaagcgtttgcgcagctcagaacgggcgagaccggcgcgtgatcgcgccgttatcattccgtgacgtgagatatttcacagttcagccgccggagaagggcggcaaaacgtcgatcgtgtcaccggaccgcaacgactgggtctcgtcgcggaccgcgatcccgtcacacaggtaggagcagcggctcaacacctcggccaggcgggatccgcgcaccgcgagccgctcgaccagctcgcccaccgtggtgccgggccgcaccaccaccaccgtctccgactcggcgcccgccgccgcccgggcggccgcgaagtagcgcaccgtcactgagatgccgttggcctggaccgggacgcgtcccatcgggctagccaccgatcgcgctcatcgggcggtcgggctggatgaagttcgggtcgttgatgccgtgaccggcgggcttggcccacatcgcggcgcgccacgccgcctcgacggcgtcgtcggctgcgccgccgcgcagcagcccgcgcagatccgtctcccgcgtcgagaacaggcagctgcggatctgcccgtcggccgtcaaccgggtgcggtcgcaggtcgagcagaacgcgtgcgagaccgacgcgatgacaccgaattcgccgccgggcgttcccgggccggtgtcgaccagccacagctgggccggagccgatccgcgcggtgcggggtcgggacgcagccgaaaatgcttgcgcagcaccgccagcaccgcgtcggcactcagcgcggcgtcccgccgccattggtgccccgcgtccagcggcatctgttcgatgacgcgcagctggtagccgtattcgaggcagtaccgcagcaactgcacgacgtcctcgcgtccggtgccggggtcgagcaccgcgttcaccttcaccggcgtcagacccgcttctttggcggcggccaagccggccagcacgtcggcgagccggtcgcggcgggtgatggccgcaaaatgttcccggtccacgctgtccagcgagatgttgacgcggtccagtccggcgcgggccagcccggcgggccagtcccacgccgttggtggtcagcgagatctccgggcggggccgcagtgcggccgccgcggccaccacctcttcgaggtggcgggccaacagcggctcgccgccggtgaaccgcacgctggtgacccccaaccgggtgaccgcgatgcgcatcagcctggtcagctcgtcggaggtcagcagctgttcgccgggcagccagtcgaggccctcggcgggcatgcagtaactgcaccgcaggttgcagcgatcggtcagcgagatccgcagatcggtggcgacgcgcccataggtgtcgcgcagcgggccgctcgacggcgccggcgcggcaagcgcgccgtcgagcggccgggccgtcgaagcggctcggcatggtcggcagacccagcgcggtcagcgtcatgcggccaccggcggagcgtgcggaaccggtgagccgaccgggacgatctgcttgcccagcggcatcagcgacaccggaatcagtttcaggttggccagtgcgagcgggatgccgacgatcgtcagcgccatcgcggccgcgctgaggagatggccaatcgccagccacacgccgaacagcaccacccagatgacgtttccgatcagggcgccggagccggcggtcggcttgtcgacgatggtgcggccgaacggccacagcgcgtaggacgcgatgcgcagcgacgcgaagccgaacgggatggtgatgatgagcaggaagcagacgagcgccgccgccaggtatccgacggccatccacagcccgccgaacaccagccagatgacattgagaatcaggcgcatatctcctccgcggtattaccaagcgtaccgagtgacgaataacgggggtgctcgcgaggcgcgcacccgagtaggatcagactcttaatacggcgtcctgcgcaggcgggacgcttattgtgttgcctatttcattgattcgtcagacaagcaggtgagaccagtgccgaccggcaaggttaagtggtacgacgctgacaagggcttcggcttcctgtcccaggaggacggcgaagacgtgtacgtccgctcgtcggcgttgcccgctggcgtcgaggggctcaaagcgggccagcgcgtggaattcggcatcgcctccggccgccgcggaccgcaagcgttgagcctcaagctgattgagccgccgccgagcctgaccaaggcgcggcgcgaggggcctgccgaacacaagcacagccccgacgagctgcacggcatggtcgaggacatgatcacgctgctggaaagcaccgtccaacccgagctgcgcaagggccgctaccccgaccgcaagaccgcgcgccgggtctccgaggtggtcagggcggtggcccgcgagctggacgcctgacacaccgtttgtcagcgcctgtttgcagttgaccgtggtggcgggccgcacagggggtactcacaccccattgacggccggcgagcagggaggctgcgatggcacagcaaacgcaggtcaccgaggagcaggcgagagcgctcgccgaggagtcgcgcgagaccggttgggacaaaccgtccttcgcgaaggaactgtttttgggtcgctttccgctggagctgatccacccgttcccccaaccctcggacgccgacgaggcccgcacccgcgcgttcctcgaccagttgcggaaatttctggacacggtcgacggcagcgtgatcgaacgcgacgccgaaattcccgccgaatatgtgcggggcctggccgacctgggttgtttcggcatgaaaattccgtccgaattcggcgggctgaacatgtcccaggtcgcctacaaccgggcgctgatgatgatttcgtcggttcatcccagcctcggcgcgttgctttcggcgcatcagtcgatcggggtgcccgagccgctcaagctcgccgggacgcccgagcagaagcgtaaattcctgccgcgctgcgccgcgggggccatctcggcgttcctgctcaccgaaccggacgtgggctccgacccggcgcggctggcgtcgacggccaccccggtcgacgacggcaaggcctacgaactcaacggcgtgaaactgtggaccaccaacggtgtggtcgccgagctgctggtggtgatggcgcgggtgcccaagtccgagggacaccgcggtgggatcagcgccttcgtggtggaggccgattccccgggcatcaccgtggagcggcgcaacaagttcatggggttgcgcggcatcgagaacggcgtgacccggctgcaccgggttcgggtgcccagcgagaatctggtcggccgcgagggtgacggcctgaagatcgcgctgaccaccctcaacgccgggcggctgtcgatacccgcgagcgccaccgggtcggcgaagtgggcgctcaagatcgcgcgcgaatggtccggcgagcgggtgcagtggggcaagccgctggccgagcacgaggcggtggcccgcaagctgtcgttcatcgccgcgaccgtctacgcgctggacgcggtgctggagctgtccgcccagatggccgacgaaggacgcaacgacatccggatcgaggcggccctggccaagttgtggtccagcgagatggcctgtgtcatcgccgacgaggtgatgcagatccgcggcgggcggggctatgagaccgccgaatcgttggccgcgcgcggcgaacgggcggtgcccgtcgagcaggtgctgcgcgatctgcggatcaaccgcatcttcgagggcgccagtgagatcatgcggctgctcatcgcccgcgaggcggtcgacgcgcacctcgccgcggcgggtgacctggccaagccggacgccggtctgcgggagaaggccgccgccgcggtcggggcgagcgggttctacgcaaagtggttgccgcagctggttttcggtgaaggtcagcgtccgcgggcctaccacgagttcggggcgttggcccgccacctgcggttcatcgaacgatccagccgcaagctggcgcgcaacaccttctacggcatggcccgctggcaagccaagctcgagcagcggcagggctttctcgggcgggtggtcgacatcggagccgagctgttcgcgatgtcggcggcctgcgtgcgcgccgaggcgcaacgcaacgccgatccggtgctcggtcagcaggcctacgagctggccgaggcgttctgcgcgcaggccaccctgcgggtggaagcgctgttccaggcgttgtgggacaacaccgacaccggcgatgtcgcgctgacccgcaacctgcagcgaggccgctacacctggctcgaggacggcatcatcgaccagtcggaaggctccgggccgtggatcgcccattgggaagagggcccgtcgaccgaggtcaatctggcgcggcggtttctgacgatctgattcgcgtcgctcgggtggacgtcgggcgttcgggcagtatgggaggtatggccagctacgtcgccgggtcgggggagttcacccgcgacaccgactacatcaccacccgcatcaccgccgacggccgcgacggctacccggtcgagcccggccgctatcggctggtcgtggcgcgcgcctgcccgtgggccaaccgggcgatcatcgtgcgccggctgctgggcctggaaagcgttctgtccattggcttttgcggccccacccacgacgagcgcagctggacgttcgatctcgatcccggcggcgtcgacccggtcctcaagattccccggctgcaggacgcctacttcaagcggttccccggctaccccaagggcatcacggtgcccgccatcgtggacgtcgggaccggggcggtggtgaccaacgacttcgcgcagatgacgctggatctgtcgacggagtggagcgcataccaccgcgacggtgcgcccgagctgtaccccgagcggctgcgcgccgagatcgatgaggtgaacaagcgggtgtacaccgaaatcaacaacggtgtgtaccggtgcggcttcgccggttcgcagcaggcctacgaggcggcctacgaccggctgttcaccgcgctggactgggtgagcgatcggctggccgatcggcgatacctggtgggcgacaccatcaccgaggccgacgtgcggctgttcaccaccctggcccggttcgacgccgtctaccacggccacttcaaatgcaaccgcagcaagctgagcgagatgccggtgttgtgggcctatgcccgggacctgttccagacgccgggcttcggcgacaccgtcgacttcgtccagatcaagcagcactactacatcgtccactccgacatcaaccccaccgggatcgtgccgaaggggcccgacctcgccggctggctgacaccgcatgggcgagaagcgttgggcggcaagccgttcggcgacggcacgccgccgggcccgccggtcgaagcggagcgggtgcccgccggccacggcgcctaagggcggtccttgccgccgaacgtcgacttgttgggcgaaatcggctgggttgtgcccaacaagtccacgttgggcgatcgaagcgggcaccccgatgcgcgcagggcgttgcgggtgcgcgacaggatgtcgtacgggcggtatcgcagcatgtcggcgctcacccggacgatcgtccaaccacgcgcctcgagttcggccaaccggtcgatgtcgcgggtccgctgcgcggggtccgtccaatgctgggcgccgtcgaattccacgccgaccttccattcctcccatcccatgtcgatgcgcgccagcaccgcgccccattcgttgcgtacttcgatctgggtttgtgggcgcggcaatccgctgccggcgaggagcaaccgggtcttcgtctcgtacggtgattcggcgccgccgtcgaccagagtcaggacacgtcgcaactgcaccagtccgcgggctccgcggtgccggtcggccagcagctcgacgtctgctgtcttcacgtcgctcacatgcatgagggcgtcgagccgaatcaccgcggtagtcaagtcctttcgccggcccaggtcgaatgccgtgcgtgccggcgtggtgaggctcatcccgtcgcgcatcgtcgtctcgtcgtcgcaaagggtgtcactgtgcaagatgatgccgcgggccttgtctcggccggcgcggttgagctcggcgggcagccagtcgtcgatccacgcggtgcggtgtagcgccgccgcggacaggcccgccaacgttgcggtccgtccggaccacagccaggcggcgacggcccgggtcaccggcgtcagctgctgcccacgacggacgtatacgttgcggtgaaccatcgtgaattcggttcgcaaccggtgccgggtgacgaccccggccgctagtgcgtcggtgcctcgaaaaggccagtcagggattcccatggggacacggtgccggtggcaccgacacgtcccgccgaacgtcgagttgtggcgggaaaccgcggcgtgtcggcgcaacaactcgacgttggacgccagaagggctaaaaggtcaggcgcacagaccattccgcgtgcgggacgtcgcgcacctcgcccgcggggtccatcgccaacgtcagcagctgcaccacgatcccggccagccgcccgcgatgcgggtcgaccgacgggatggtcaccgcgaaccgggtgcccgggcggtagatggtgctggtcgtgttgccgggatcctcgtacacctgcagcagccgccagggggcgcgcgcgatggcgtcgggcaccgagagctgaatcgggtagcgctcgctgaccggcaattcgccctggctctgcggtgtctcgcagtcttcgaggttgagaacgttgcagtacaggtagggcccgacccgggtcaggtggccgtgcgagtacgcgctgatctcggggcgttgcgggccgccgcggccgaccagcagccaggtgccgacgccggccccggcgcagagcacgatcatcaggcaggcgagcagcacagccccgccccgccgggtcttgggcttcactcggcgaccaccgccgggctgccgacgccgcggcgggcgccctcctgctcgaccatgatgggtctgttacctcccaggccgggaatcagcgagttgccgcggaagctgaccagcgtctgcgccaagcccaggatgagcagggcggtgaccgcggtgaacccgacccacaattcggtgtacaccagcacgcccagcgcgccgccgaggacccaggccaactgcagcgtcgactccgagcggccgaaccccgaggcgcgggattcctcgggcaggtcgtcctgcagcgccgcgtccagggaggccttcgcgatggcgctggcccccgacgtgaccagggtggcgatcacggccagcatcaggttgccggccaccgaggcggccagcgcgacggccgtgaccgccaccgtgcagcgcaccaccagcacggcgggccggcccagtttgagtcgcgcgctggtgaagttgccgacgaagttgccgacgccggccgcggcgccgatcatcccgagcatggcgagctgggcccagccgttggcctgatgcgccttggccacgaacgcgggatacaggaacagaaagcccaccatcaccttgatggtgcagtttccccacagcgaggtgatgatgttgcggcccaacggttgtcgcagcgtggcggtggcctttttggggacgttcttgacttcctcgggccagcgtcggcgcagcggctcgctgtcgcggcggtagctcagggtggcgggcacctcgcccgcggtcacctcgacccagcgcgggatccgcatggacagcgacgcccccgccacggtgacggccacgacgacgaacagggcgccgggcagcttgaacagatgggtgcagacgaattccacaccaccggcgatggcgccgccgacgatggtgccgcccagcagaccgaacatggtcagccgcgagttgacccgcaccaggtcgatgctcggcggcatcacccggggcgtcaccgcgctgcgcagcacggagaacgatttcgacagcaccatcatggccagcgcgcacggatacagcaccatcgacgggtaactgccgctggcgccgtcgtagttcatgatcagcaccgccgccaaggcggtccgcaggacgaacgaggcggccaacgcgacgcggcggccgtgctgcagccgatccagcgccggaccgatgagcggggcgatcaccgcgaacggcgcgatggtgatcaacagatacagcgccacccggcccttgctctccccggtcgccgcggcgaagaacaacgtgttggccaacgccacggccatcgcggcgtccaccgcgaagttggccaccaccggccaggtcagcgcggtcaggccggacttgtcggcgccgtcggcggtcgcggcgcgctgcaccatccagtacatccgcgaacccatctcgcggctgcgcagcgccgcggcgcgggtgacggtgatccgctcgccggcgaccggtccccgcggcggggcggcggcgccgcggtccggctgcggctggtggcccagcggcggtagatagcggttggcgctgggcatcggcggcgggcggcgcgtccggcggtcgccggtgtcgccggccgggtaattggccgcgccgggatggggtgcggcagcgctgttgccgggccggcggcccggcttggcggccacccggcccggatcgccttgccgccgtccagacacgccccgattctcccctatgccgactccgtgcgtctgcaggtaacggggcgtggctcgtcaacctactattggaaccgcgatgcagacacaagacagcgtgaccacacctctcgaggagtcctcgatggcgaccgcgggcgagtggcccgaagggttggcggcggtgctcaccggcgctgccgaccaggccagggccgccgtcgtggagttcagcggggcggagacggtcggcgactatctggccgtcggctacgaagacccgtacgccgccacgcaccggttcctggcgcacctgcccggctaccagggctggcagtgggcggtcgtggtggccgcctatcccggcgccgaccacgccaccatcagcgaagtggtgttggtgccgggcccgacggcattgctggcgccggagtgggtgccgtgggaacagcgggtgcggcccggcgatctcagcccgggcgacctgctggctcccgccgccaacgatccgcggctggtgcccggctacaccgccagcggcgacccgcaggtcgacgagaccgccgccgagatcgggctgggccggcgctgggtgatgagcgccgagggccgcgcggaggccgccgaacgctggcacaccggcgcgtacggccccgactcgccgatggcccgatcgaccaagcgggtgtgccgcgactgcgggttcttcctgccgctgtcgggatccctgggcaggatgttcggggtgtgcggcaacgagctgtcggccgacgggcacgtcgtcgacatgcactacggctgcggcgcgcactcggacacccccgccccggcgggcaccggctcgcccgcctacgagccctacgacgacggcctgctcgacgtgacgcagacaccggtcgagccgacgccgccgcccgagacgtcgcaagccgagcccgagacgtcagaagtcgagccggagacgcaagccgagccggagcccgagaccgagacgcccagctagcgccggtccgtgttctcggcggcggccttgatgcgcgccaacgaggcgttcatgccgtcgagcaattcgcgttcgaagttgtcggtgccgccgaggaacgccttgaccgacaggttggagaacgcggtgacgccgttctcggcgtgccggctctcgatcagccgggtgccggtgtcggtgggttcgagctcgtagctccagatcgtgttgttggtgtccacccggaacgtgagtttgcggtcggggatgatctccaccaccgtgcaggtggtcggccagaacaaccggttgcgccgattgaggttgatggtgcgggtgccctgacgcaccgggcccagcggtttcatccaccggcactgcgggctccactgcggcatgcggcgcagatcggaaaccaatttccacaccgtggcaaccggggcgtcgatgtcgatctgcgctcgcaacagcggggctaccatcgctcctccaacgggtcggcgaactagtcgtgctcgaggaaattctccaggccggtttgggcgccgcgggcaccgcgccgggcggcggccagctgcagcagaaagatgctggtgcccagcacgcccacgcccaggccggccagtgtcaccgggcgccagcagtgcaggcccggcaccaggaaggcggcgcccaccgcggccagccaacccagcgcaccgagcgcgatgaacggccacacccgcagcagcgccgccggcagcggcggcgcggtgcggttcgggccggattcggtggacatcgcgattaacataacccgccgccgccgctcgtcggtggcggcccggttgcgcccgacgggcgatcgaaaaccgctgagcgcagcgggatacgcgggcgggtaagcgtttcgatgaaacggcgggcggttcggccgggggcgtcaacacccgtcgttcaccggttcgtgtcccggtttctcaggcttgcgtgtaacctcgcgccatgcctgacagcgatgcccggctggccagcgacctgtcactggctgtcatgcggctggcccgccaactgcgattccgcaacccctcgtcgccggtgtcgctgtcccaactgtcggcgctggcgatgctggccaacgagggcccgatgacgcccggggcgctggcgatccgcgaacgcgtccggcccccgtcgatgacccgggtgatcgcctcgctggccgagatgggcctggtggaccgcaccccgcatcccgtcgacggccggcaggtgctggtctcggtctccgaggccggggccgaattggtcaaggccaaccggcgcgcccgtcaggagtggttggccaagcggctgtccacgctggacgacgacgagcgcgaaaccctgcgccacgcggccgatctgatgctggccctggtcgacgaaggcccgtgaacaccgatgcgctggacgttcgcgacgttgacgaccccgacgacccgaggctcgacgacttccgcgacctgaacagtgtcgatcggcgtcccgatctgccgtcgggcaaggggctggtgatcgcggaaggcgtgctggtggtgcagcgcatgctggcgtcccggttccgcccgcacgccctgctggggaccgagcgccggctcgccgagctgcgcgacgacctggccggcgtcccggtgccgtactaccgaacgtcggccgacgtgatggcgcgggtggtcggctttcacctcaaccgcggggtgctggcggccgcccggcgggtgccggagcccggcgtcgccgagctgctggccggcagccgcaccgtcgcggtgctcgagggggtcaacgatcatgagaacctgggcgcgatcttccgcaacgcggcggggctgggcgtcgacgcggtgatcttcggcagtggctgcgccgacccgttgtaccgccgcgccgtccgggtgtcgatgggtcatgcgctgctggtgccgtacgcccgcgcaaccgactggcccgccgagctgaagacgttgaaggagaatggatttcggctgctggcgatgacgccgcagggttccgcgtgcggcttggccgaggcgatgacggcggcccgcggcgaccgcgtggcggtgttggtgggtgccgagggcccggggctgacgccggccgcgctgcggttgagcgatgtgcgggtgcgcatcccgatgtcgcggggcaccgactcgctcaatgtcgcgacggcggccgcgctggcgttctacgagcggtctcgcccggtcggggtgcaccgcgcggcggccggaggcggagatggacagtcgggctaggctgcggctgatgaaggacgagaccgtgccctgggcaacgggtttgacggtgaccgcgtttgtcgcggcggtcaccggcgtcgcgatcgtggtgctcagcctgggtctggtccgggtgcatccgctgctggccgtcggcctgaacatcgtggccgccgggggactggcgccgacgttgtgggggtggcggcgcaccccggtgctgcgctggttcgtgctgggcgccggggtcggcgtgaccggcgcgtggctggtgctgctggtgctggcggtcgcgggttagcgctgaccgccggagcgcacaccgagcagcacgtcttcccaggccgggatgaccggcttgccgcggcgggtgtgcaccggcttttcctccggttcggcgggttcggcggccggcggcttggccggttcttcgaagtcgacgtgggcgacccgggccagcggccgcagcggcagctcgaagttgggatcgatcagggcggtggccgcgtcgtcgatggcggtgacggtgccgccgtgggcgccgggggtgaagcagaagtgcgcgacgttgtccgagcggccgaccttccaggccagctgcaccgtccagcggttgtcttcgttgcgccacgcgtcccagctgagtttgtcgtggcgcagcccccgggtcacgaaggccgcggtgaccgtctccagcagggtcagcaccgccggaccctccgccagcatcggatgtgcggcggttgccagctcggcggcccggtagcgctccagcagcaccggatgggcgaaccggcgcacccgtgacacgtccgagcccgatgccgccgcgacctgctccaccgaggcgccggcgcggatcttggcctgaatttctttggggctcaacatgttcgtcacttcgatctcgagctgcggctgctcgggaggctcggcttcgtggcgcaacacggcccgcaggtggtcgtcggcgggcagcttgaactgctctgcggggtcatcactttcgcagatcaaatatttgctgtcggcatcgagcccaaccactttgagttcccgcatggctatctcctcgcaggctccgtgcagctcagcgacggacccgtcaggtgcgcactttagtccagcaaccgcccgtcacctgtgctgacacgctgggtggttgcgggctgattgctgtccggttacagccgctcgacgacccagtccacacactgggtcagggcgctgacatcgtcggggtcgaccgccgggaacatccccacccgcaactggttgcggcccagtttgcggtacggctcggtgtcgacgacgccgttcgcgcgcaggatcttcgccacggccgcggcgtcgacgtcgtcgacgaagtcgatggtgcccaccacctgcgagcgcagcttcgggtcggcgacgaacggcgtggtgtagtcccgctcctcggcccaggagtacagccgcccggcggagtcggcggtgcgcttgacggcccagtccagcccgccgttgcccagcatccagtcgacctgctcggccatcaacgccagggtgccgatcgccggggtgttgtaggtctggtccttcaggctgttctccaccgcgatgggcagcgacaagaagtcgggaacccagcggccggacgcggcgatggactcgacgcgggccagcgcggccgggctcatgagcgccagccacagcccgccgtcgccggcgaagttcttctgcggcgagaagtaataggcgtcggtctcgccgatgtcgaccggcaggccgccggcgccggacgtggcgtcgatggcgaccaacgcgtcaccggaatcgacggggcggcggaccgggaccgcgacgcccgtcgacgtctcgttgtgcgcccaggcgatcaggtccaccgacggatcgctctgcggttcgggtgcgctgcccgcgtccgacttgatgacgacgggatcgccgacgaaggggttcttggcgaccgcggcggcgaacttggagctgaattcgccgtaggacaggtgcagcgagcgcttgtcgatcaagccgaaggccgcggcgtcccagaacgcggtcgcgccgccgttgcccaggatgacctggtagccgtcgggcagcgaaaacagctcggcgagccccgagcggagccggccgaccagattcttcaccggcgcctgccggtgcgaggttccgaacagcggcgccgcggtcgtgctcagcgcctgcagttgctcgggccggaccttggacgggccgcacccgaagcggccgtcgcggggtttgatgtcagcggggatctggagctggtcagccatgctcatcagggtagtgagccgacgcggcgggccggcggggcgggccgcccggcggcgcggccgggcggggcaaaacgcctgttcgggctggtgcgagggtttcgccggctgtgatccagggcataccccggaaatgaccactggtcaggtcacagtgcccgggaggggtctaggaaatatccggtacctccggtactgtctggacatagcacgtccaaatgtaaacctcgttgaggaggcctggatatggctaggacgcggatggtccggcgttggcgccgcaacatggaggtgcgcgacgacaccgaatacgtgaacatgcttgccacactgtccgaggggtcggtgcggcgaaacttcaacccgtacaccgacatcgactgggattcaccggaattcgcggtcaccgaggacgatccgcggtggattctgccggcgaccgacccgctgggccgccacccctggtacctggcgcagtccgacgagcgcaagatcaagatcggcatgtggcggcaggccaacgtggccaaggtgggactgcacttcgagtccatcctgatccgcggcctgatgaactacaccttctgggtgcccaacgggtcgccggaataccggtactgcctgcacgagtcggtcgaagagtgcaaccacacgatgatgttccaggagatggtcaaccgcgtcggcgccgacgtcccgggcatgccgcggctgctcaagtggatctcgccgctgatcccgctggtggccgggccgttgccggtggccttcttcatcggggtgctcgccggtgaggagccgatcgaccacacccagaaaaacgttctgcgcgaaggcaagtcgttgcaccccatcatggagcgggtgatggccattcacgtggccgaggaagcccggcacatctcgttcgcgcacgagttcctgcgtaagcggttgccgcacttgaccaagcggcagcggttctgggtttcgctgtactacccgctgaccatgcggctgttgtgcaatgcgatcaccgtgccgcccaagcagttctggcgcgagttcgacatcccccgtgaggtcaaaaaggagctcttcttccggtctccggagtcgcggaagtggttgagcgacatgttcgccgacgtccggatgctggctcacgacaccggcctgatggagaaccgctcggcccggctgatgtggcggctgtgcaagatcaacggcaagccgtcgcgctaccgcagtgaaccgcagcggcagcacctggctgccgtgccggccgcctaaccacggcgagttcctttatgccgcacgttattacccagtcgtgctgtaacgacgggtcctgtgttttcgcgtgcccggtgaactgcattcaccccacgcccgacgagcccggcttcgccacctcggagatgctctacatcgacccggcggcgtgcgtggactgcggcgcctgcgtcagcgcctgccccgtcggtgcgatcgcccccgacaaccggctggacgacaaacagctgcccttcgtcgagatcaacgcgtcgttctacccgaaacggccggccggccagaaactgccgccgacgtccaagctggcgccggtgatcccggccgtcccggtgcggccgcgcggccggccgctgacggtggccatcgtcggatccggcccggcggcgatgtacgccgccgacgaactgctcacccaggacggcgtgcgcgtcaacgtcttcgagaagctgccgacgccctatgggctggtgcgcgccggggtggcgcccgatcaccagaacaccaagaaggtgacccggctcttcgatcgggtcgccggtcatgaccgcttccggttctacctcaacgtcgaggtcggcaagcatctcagccacgccgatctgctggcccatcatcacgccgtgctgtacgcggtgggggcgcccgacgaccgccggctcgacatcgagggcatggggctggcgggcagcggaaccgcgaccgagctggtggcgtggatcaacgggcatcccgagttcaccgcgctgccagtcgatctgcgccacgagcgggtggtgatcatcggcaacggcaacgtcgcgctcgacgtcgcccgggtgctcaccgcggaccccgatgacctggcccgcaccgatatcgccgaccacgcgctggcggcactgcgcggctcggcggtgcgcgaggtggtgatcgccgcccggcgcgggccggcccagtcggcgttcacgctgccggaactgatcgggctcaccggcagccgcgaggtggtgctcagcgcggccgaccgcgagctggtcgccgccgacctggcgaacgcctcggatgccctgaccaaggccaagctggaggttttgagcacgctcggcgacgctgcggcgcccagcgagcgtccgagaatcaggctggcgtatcggctcacccccgaccggatcctcggcgagcaacgcgtcaccggtgtgcagttcacgctcaccggcaccgacgagacacggtgcctgccaacgggtttggtgctgacgtcgatcggctaccgcggcaagccgattcgcgacctgccctacgacgaggcggcggcggtggtgcccaacgacggcggccgcgtcgtcgaccccgcctcgggacgaccggtgcccggcgcctacgtcgccggctggatcaagcggggacccagcgggttcatcggtaccaacaagtcctgctcgctgcagaccgtgcaggccctggtggccgatttcaacgccggcgagctggccgacccggcggccaaacccgaggcgctgaccgccctggtgcgtgcccgccggcccgacgcgatcgacgcggcggggtggcgagccatcgacgccgccgaaatcgcgcgcggcagccaggacggccgaccgcgcaacaagttcaccgacatcggcgacatgctggccgccgcggccgccgcagagccggcgccgccgccgcgacgccggctcctggcccggttggtgccgtccgggcgcggctaggcctgcccggccccctgctcagcggccatcgccgccatcgccgccgccatctcctccgggctgacctcgcgcaccggctgccccagggaccagtggtggccgaacgggtcggcgaccatgccgtagcggtcgccccagaactggtcctccaacggcaccaccacggtggcgccggcatcgaccgcccgctgaaagctcgcgtcgacgtcgggcacggtcaggtggatggtcaccggggtgccgcccaacgacgtcggcgtcatcgacttgccgccgcacacttccgggaagtcgtcgttgagcatcaccatgaagccgttgatgcgcaccgcggcgtgcgccagtttgccgtcgggacgcggcaggcgccccagctcctcggccccaaaagccttgacgtagaagtcgattgccgcggccgcgttgtcgaccaccaggtgcggggacagtgcgggctcgatgttgatcgccatgctggcactccttgctgtcggttccagacctgcccggtgcgggcaggctcacgacttatgactgcgtcggtgacgcaaactcatcgcgacggcaatcattagatcgccgggtaccgacaaccgggcctcaggcgttggtgaggctgcggtcccaaccctcgacggattccgggctgcgcgggccggggcccacgtagatcgccgacgggcggaccagcttgccgagccgcttctgctcgagaatgtgggcgcaccaccccgcggtgcggccacaggtgaacatcgccggcatcatgttggccggcacccgggcgaagtccaggatgaccgccgcccagaactcgacgttggtctcgatggcccggtccggacggcgctcgcgcagttcggccagggcggcctgctccagtgcgacggcgacctcgtgccgcggcgcgccgagccgctcggcggtggcgcgcagcacccgcgcgcggggatcctcggcgcggtagacccggtgcccgaagcccatcagcttgtcgccgctgtccaggatcttcttgaccagccctcgggcgtcgccggtgcgctcgacctcctcgatcatcggcagcacccgcgccggcgccccgccgtgcagcggtccgctcatcgccccgatcgccccggacaacgcggccgccacgtcggcgccggtggaggcgatcacccgcgcggtgaacgtcgaggcgttcatgccgtgctcggcggccgacacccagtaggcgtcgatcgcctcgatgtgccgcgggtccggctcgccctgccaccgcgtcatgaaacgtgcagtgacggtttcgcattcgtcgatgacccgctgcggcaccgcgggctgatagatgccgcgcgcggactgcgcgacgtaggacagcgccatcaccgaggcccgggccagctggtcgcgggcggtggcgtcgtcggtgtccagcagcggcttgtagccccagatcggggccagcatggccagcccggcctgcacgtcgacgcgcacgtcgccggtgtggatcggcagcgggaacggctcggcgggcggcagcccgtggccgaacttgccgtcgaccagcagcgcccacacgtcgccgaacgtgacctgctggctcaccaggtcttcgatgtcgacaccgcggtagcgcagcgcgccgccgtctttatccggttcggcgatttcggtggtgaaggcgaccacgccttccaggccggggacaaagttctcggggacaacagtcatgggaaaattctcgcaccccgccctggggcggacgctaccggccggtagcaagcgccggtagcgttggcgcggtgccgggaccagcagacgagcacctgcagagaatgcgtgtggaatacggatcggtggaaaaggacggcagcccggatctggacgtcgactggctcgacgacggctgggttgcgttgttgcgcaagtggatcgacgacgccgagcgcgccggggtggccgagcccaacgcgatggtgctggccaccgtcacccccgacggcagaccggccagccgaacggtgctgtgcaagagcctggacgagacggggatcacttttttcaccaactatgactcggccaaggccgacgatctggcggcgacgccgtacgccgcggtgacgttcccgtggtaccagctgggccggcaggtccacctgcgcgggccggtgagcaaagtcacggcccaggtcaccgaggactactggtccaagcgaccgcgcgggtcgcagctgggcgcctgggcgtcgcagcagtcccggccgatcgcctcccgcgcggccctgctggagcagctggcgcaggtgacggcccgcttcgccgaccacgagcgggtgccggtgccgccgggctggggcggctacctcatcgccgccgacgtggtggagttctggcaggggcgggaaaaccggttgcacaaccgcatccgggtcaccggcgaccgggtggagcgtctgcagccgtagcgcgccgggccacttgatcgattgcgtgaccagcggactcgaccccgggcaggcgcctcctcgccataacgactaccttcagctgtaagcacctagtcagggcagccatatcagccagagcgcaaaggggttctcgtggccgacaccgacgacatcgccactttgaagtacccgggcggggaaaccgacctggagatcgtcagcgccaccgagggcgccgacggcatcgcgctgggttcgctgttgtccaagaccggctacaccaccttcgacaacggctttgtcaacaccgcctcgtgcaagagcgcgatcacctacatcgacggcgacgccggcatcctgcgttaccgcggctacccgatcgagcaactggccgagaagtcgaccttcctcgaggtgagctacctgttgatctacggcgagctgccggacaaggaccagctggccgagttcaccaagcggatccagctgcacaccatgctgcacgaggacctgaagcggttcttcgacggcttccctcgcaacgcccacccgatgccggtgctgtccagtgccgtcaacgcgctgtccgcctactaccccgattcgctggacccgatggacaccgaggacgtcgagctgtccacgatccggttgctggccaagctgccgaccatcgccgcgtacgcctacaagaagtcggtcggccagcccttcctctacccggacaacaagctgagcctggtggagaacttcctgcgcatgacgttcggcctgcccgccgagccgtaccaggccgaccccgaggtggtccgcgcgctggacatgctgctgatcctgcacgccgaccacgaacagaactgctcgacgtcgacggtccggctggtggggtcctcccaggccaacctgttcacctccatctccggcggcatcaacgcgctgtgggggccgctgcacggtggggccaaccaggcggtgctcgagatgctggagaagatccgccaaagcgacgacgacgtcagcgaattcgtgcgcaaggtgaagaaccgcgaggccggggtgaagctgatgggcttcggtcaccgggtgtacaagaactacgacccgcgggcgcgcatcgtcaaggaacaggccgacaagatcctggccaagctcggcggcgacgacgacctgctcgacatcgccaagcaactcgaagaggccgcgctgaccgacgagtacttcatcgagcgcaagctgtaccccaacgtcgacttctacaccggcctgatctaccgggcgctgggcttcccgacccggatgttcaccgtgctgttcgcgctggggcgcctgcccggctggatcgcgcactggcgcgagatgcacgacgagggcgacagcaagatcggccgcccgcgccagatctacaccggctacaccgagcgcgactacgtcaccatcgacgcccgctagttttcccgctcaccgggaggacagggaggacagcaccgccatcgcggcgttgtggccaccgatgcccgacaccgccccgccgcgccgggcgcccgagccgcacaacatgattcgttcgtgagcggtggccacgccccattgccgcgccggggtgtccagcgggttgtcgtcgtcggcgaacggccagtccaggccgccgtggaagatgttgccgccactcatgttcagggtgcgttccaggtccgcggtggtggtggtctcgatgcacggtcggccccgcgcatcggtcagcaacagctcttgaatcggttcggccagaacggaattcagtgaggccagcacccggtcggtgagctggccgcgcagcgtgtcggggtcggcgccgcgcgccagcgcgtgcggggtgtgcaggccgaacaccgtcatcgtgtgggcgcccgcggcgcgcaggtcgtccgacaggatgctggggtcggccagcgaatggcaatacgcctcgcacggcaacggattcgggacctgccccgcggcggcccgggcgtaggcggtgtccagctgggtccaggtttcgttgacgtggaacgtcccggcgaaggcctgctcgggggtgacgccgccgtcggccaagcggggcagccgccgcagcgccatgttcaccttgacctgcgcgccggcgatcgccggtgcggggtgttggccgagcaggccggccagcaccgtcggggtcaccccggcaagcacgaaccgggcccgagccacgtgctcgtcgtcgccgctgcgataacgtaccgcgccgctcgggtcgacggcgaaaacctctgcgccggtgaggatttcggcgccgtgtcggacggcggcggtggccagggcggtggtcagcgcgcccatcccgccgaccgggacgtcccagtcgccggtgccgccgcccagcacgtgatagaggaagcagacgttctgcgtcagcgacgggtcgtcgagacgggcgaacgtgccgatcagcgcgtcggtggcgatcaccccgcgaaccaggtcgttgcccaccgcatcggcgatggcggcgccgatcggctcctcgaccagggcgcgccacgcggccgccgcatcggcaccgccgccgtcgaccacatgccggcgcgcgtgccggcggctgcgcagcggttcgagcagcgtcggccacagccgttcggtcaccagccggcagcgttggtagaacccggcgaacccgggtgcgtccccgtcagcgccgaccgcggcgaacgggttgccgggcgcgccgatcagcaacccgcgggcgcccccggtcgcggggtcgggcgtgtacgaggaaaaccgccgccgggccagccgcacccgcgcgcccaggtcgtcgatgatgcgtggcggcagcagactgaccagataggagtagcgcgacacccgcaccccgacaccgtcgaaggcgtgcgccgacacggccgcgccgccgacctgccccagccgttccagcagccgcacccgaaggcccgcccgggccaggtacgcggccgcgaccaggccgttgtggccgccaccgatgaccaccgcgtcgactgttaccggccggccgctcagctcaggtagccctcgacctcgtcgggcggacgcacctgggcctcgcgcgggtcgccgccgctttcccgcagggcccggcgctgccgcagcagatcccagcactggtcgagttcgacctcgacccgccgcaagcggtcatgttcttcggaggtgtcgatgtcaccgcgctgcagctgggcccgcaacgttttctcctgggccaccaggtcgcggatgcgcgccagggtgtcgttttcgctcggtttactgccgtcggtcatcgttccagtgtgcccgactcgacaggggctaaccgcccgccgaccgccgtgcgtcgaaccgcaagcgcgggtgaggatttcaccggacggccggcgtggctagacatcccaggtccgtaagttgtcaagccgcctgggagtcggggttggtttggcggtgtgcccaggctttgtgttcgtcgtagtgggttcggtgtcgtaggcagccgtggaggatgcctacgaggcggttaccgagggcgcgtagcgcttggtggtggaggtcgccggcagcgcgacgccggtcgtagaacaggcgggcgccggggctggtgttcagggcgcagaaggcccattggtcgatcgcgtcgtagagccggcggttgcggacgtggcgggccagcacggcgcgtttgcggccggaggcgacggtcagcggcgacgttccggcgtagtttttgcgacacttggcggtggtgtacctgttcgggtcgtccccgaactcaccgagcacccgggcgccgaggatgacaccaagtcctggcagggagcggtagatgtcggcgtccgggtgtgtctcaaaatgtgttgccagttcggcctcaaggtcggtgatctggcggttcagttcagcgatgatgccgaccgtggcgcgggtggttgcgccgaacgcggcggtgaccgcggcaggggcggcgagctgctcagcgcgtaaagcggtttgaatgtcctgggcgacggtgtcgaggttgcgttgtcgcccagcggctttgagtgcagaccggatcttcgacagactcaggttcgccgcttgcatgggggtgggcgctcggcccaggatcgccagagcgtcgcggtcgtgcagatcgtcgaacgcctccagcgcgcctgggtagtactcgcgcagcgccgagcgcagcgcgttggtgtgccgattgcgggtccagatcagattctgatgtgcccgggccagcactttgaccgcctcggtatcagcggagtcaccggcgacgcggcggtgattgtggcgatcggtgcgcaccagatccgccaagagcttggcgtccccggcatcggatttggcccccgacacatggtggcggtcgcggtagcgggcggccgccatcgggttgatcgcatacacctggtaatcggccgcggtgagcgcctcgacccacaaaccacggtcggtttcgattccaatcacgacctggtcgggctcttcggcatggcgggccaaaagctgatggaactcgccgatgccggcaagtccctccggtaaccgacgcgaggccagccgggccccggattcatccatcaggtggacgtcgtgatgatcctccgcccaatcgtcgccgacaaatatcacgtagcgcctcctcggtggtcatcgaacatgttcgagcccaagggcacccggcgacaagctaatggatcagtgctcaacggcacgacaccccatcagtgctacaggaaccctcaccaaccggccggggcgtgatctagccttagaagtcggccatcgcttcagctggcaacgacgctcaccgaccggcggctcggtaaacagcgtcccccgaacaagggatcaacagccgaaggctcactgttcgatccccattagctgggcccgggcaggcgcaggaccagccgggcaccgcccagcgggctgttttccagcgcggccgtcccgccgtgcagctgggcctgctgggccaccagcgccaatcccaggccccgacccggactgcgaggccgtcgatccgcgggagaaccgatcgaacaccacctgccgctcgtcctcgggcaccccgctgccgttgtcgtcgacggcgatctcgaccccggcccgggagctgaccgccgacagctgcacccgggtggcgccgccgtgcttgacggcgttggcgatcgcgttgtccacggccagccgcaatccggccggcagcccgacgatgatgcaggtgggggagggcaccagcgaaacgtcgaggccggggtagatgcgcatggcgtcgtgggcggcgcggtcgagcagctcggtgatgtcaaccggcacatggtcctcggacgtcgacagctcgccctgggccagccgctcgagggcggtcagggtggtctcgatgcgcgactgcgtgcggatgacgtcgcccagcacctctttgcgttgctcgtcgggcatgtccagggtggacagcacttcgaggttggtgcgcatcgcggtcagcggactgcgcagctcgtgggcggtcaccgccgagaagtcgcgggccgacgccagcgcctccttggtgcggtcctgctccttccagatgcgttgcagcatgccgcgcatcgcctcggcgatctcgacggcctcgctggcgccgcgcaccgccacctgcggccgctcgtcggcgtcgatcgagcgggcctgctgggccaaccgcttgaacggccgcaccgcgaaagccgccagcagccaagcgaataccgccgccgcgccgatcgacagcgcgcagatcaggatcacccgccgatgcaggttgttggtctgggcgatggtgtcgtcgtacgtcgcgcccacctccaccgtcgccggctggggcgtgcggacctccaccgtgcgcacccggtagcgcaccccgttgatgtaggtgtcggcgtagccctcttccatcggcggcagcgtgacatccgagttggacttgacctgcccgtcgcggcgcaccgtgatgaccgtgtcctggtccttgggcgatcgcgggatctcgttgagcccgcgcggcaggaagggaatcgcgaagccggccgtctcgtccagccggcgatcgaggcgctcccgccacgcgctggtgatgccgaaccacaccaccgcgccggcgatgaccaccacgatggcggtgccgatggccgtcgcgaccgcgacccgggcccgcagcgacggcgtgcgggtcacgatccgggacaacaacttcatggccgctcgacccgattactgcatgcgcagcacgaatcccactccgcggacggtgtgcagcagccggggcccgccgttggcctcgagcttgcggcgcaggtatccgatgaacacgtcgacgacgttggtgtcggcggcgaagtcatagccccacaccagctccagcagttgtgcgcgggacagcacggcggtcttgtgctcggccaggaccgccagcaggtcgaactcccgcttggtcaaatcgacgtccacgccgttgacccgggcgcggcggccggggatgtcgacctccagcgggcccaccgtgatcgtttccgacgaggaggtggcggtggcgccgcggcggcgcagcagcgccttgacccgcgcgaccagctcggccagcacgaacggcttgaccaggtagtcgtcggccccggcctccaggcccgccacccggtcgtcgaccgagctgcgggccgacagcacgcagacggggacgtcgttgtccatggcgcgcagcgcggtgacgacgctgacgccgtccagcaccggcatgttgatgtcgagcacgatcgcgtccgggcgtgtctcggtggcgctgcgcagcgcctcggcgccgtcgaccgcggtggacacctcgaatccggacagtcgcaggccacgttccagcgacgcgagcacatcggagtcgtcgtcgacgaccaagacccgcggtgagctagctgctgtgtccatgccgcctattttgcctgattgtcggccgtggctgtgggaggagcaccggcccggtcggatggcgcggcgggcaaccgggccgcgcggcgcagcatcggggcgaaggtgacccagatgatcagcgcgcccagcgacagcccggccagcaacaagaaggcagcgcggaaacccagatgttgggcgacggccccgcccagcaccgggctgagggcgccgcccaacccctgggcggccatgacggcgccctgaccgacgttgatgtggccggtgccgtccaggatgcgggccaccaggcccggcaccgccaccgacagcatgccggcgccgatgccgtcgagcacctgcaccgggatcaccccccagctggtgatgacgctggcggcgagcacaccgcggaccggcagcgcggtcagcgcgatcaggatcgcgggccaatagccgcgcgtcgccgcgattctcatggcgagcagcgaggcggggaccatcacggcctgggcgacgacgacggtgctggccacggtggtgaacgggttggcgtgggtggcgacgacggccaggccgtacagcggcagcatcgccgcgttgcccaggtggaagagcaccatggccgccgcgagcaccagcagcgggcgggaccgcgccagcacccgcatcgccttgaccggggcctcgccggcggcccgcgcctcgccgcgggcgacgtggtggtcgatgtcgccggccgggatggccagcaccgccgcgatggtcgcgaccgcgaaacccgcagcgagccagaagattccggcgtagccgaacacccagccggccaccccgccgagggcggcgcccgccatgttgccggcatggttgtaggcctggttgcgaccgttctgccgggtgaacgcggcctggccgaccaccccgagggtgatgccgatcatcgcgggggcgatcgtcgccccggagatgcacatgacggcctgcgcggtggcgaccgtccagaactgccgggaggtcaggatcaccgccgaggcggcgacggcggccagcccgacgacgatgacgcagccgcgtttgtgccgggtggcgtcgacgagtgcacccgcgggggccaccgtgaccatgccgacgatcgcgcccagcgtcatcgccgcgccgatggcgcccgtggtccagccgcggctttgcagcagcacgcccaggaacgggcccatgccggcctccatgtcggccatgaagaagtgcacggcctgcagcgcgacccggtcccggttgcaggcccgcggcgtcgccgtcatgcgatcacgcatgccttgattgtggcgaacggtccggcggctgataactgcgccacaccccaacccccttggcggaacacactttaacggtcataattagcactcgacggcttggagtgctaacgcgtgtgatggagtcgtaaggaggaaaacgtcaatgcgcggcgctgatttcgtgttgccgaccgatgtcccggaagccggccgaccgctgcggatcgtgctcgtcgccccgccgtatttcgacgtcccgccggacgggtacggcggcgtggaggccgtcgtggccgatctcgccgacatgctggtggcccgcggacaccaggtcaccctgctcggcgccggcgaaccgggcacggcggccaggttcatcccgctgtgggaccggaccgtgcccgagcggctgggcgagccctaccccgagatcatgcacgcgctgaaggtgcgcagcgccatcacccggatcgccaaagaggacggcgtcgacatcgtgcacgaccacacctttgccgggccgatgaacgccccgatctaccaggggctgggcgtgcccacggtggtcaccgtgcacggcccgatcgacgacgacctgcatccctactaccgcgagctcagcggcgacgtcggcctggtggccatcagcgaccgtcagcggcagctggctccggagctgaattgggttggccgcgtacacaatgcgctgcgcatcgacgagtggccgttcgagaccgaaaagcatgactacgcactgtttttgggccggtatgcgccgtacaagggtgcgcacctggcgctgcgggccgcgcacgaggccggcatcccgctggtactggccggcaaatgcagtgagccctcggaaaaggagtacttcgaggactgcgtgcggccgctgctcaccgacaacgaccacgtgttcggcgaggccgacgcggtcagcaagcgaaagctgttgtcgcgcgcccgttgcctgctgttcccgatccagtgggaggagccgttcggcatcgtgatgatcgaggcgatggtctgtggcacgcccgtcgtcgccctgcgcggcggcgcggtctcggaggtggtcgccgacggggtcacgggcgtggtctgcgatcacccggacgaactgcccggggccatcgcccgggcccagaccctggacccgcacgcatgccggcgccacgtcgccacgaatttcgctgtggcacagttcggttcggcgtacgaagccatctaccgcaacgtgctgcagcatgcgacggcggcgccgcgccggatgcgcagcacgggcctggtggaatcgatcgaaaccggaaggcgcgcctgcgacttcaggcagaaggcaccggcatgagcgtggcgacggccttcaacggcggcgcgccggcgcagatcgggtccggcggcgacgccgtgaccctggtcgagggcggaacgttctgcctgtccaaccggcacggcgacgtgccggtcggcacctcctacggcctgttcttccgggacgcgcgggtgctgtcccgctgggagctgcgggtggacggccaagtcgccgaggcgttgtcggtggaggcgacggaggcgttcgccgcccagttcatcctgcgccgggcaccgcggtcgggactcgccgacagcaccctgttgatcgtgcgcgagcggttggtcgccgacggactgcgggaaaccatttcgctgcacaacctcgacaaggaaagcacggtggtgtccctggagctgcacgccgacgccgacttcgccgacctgttcgcggtgaaggaggggcgcgcggccacggccggggccgacatgcacgtcgccgacggggaactggtgttgcggggccgcgccgaccaggtgcgcggcctgaccgtgtcggccagcggcgacccgatcgtgttgcccggctcgctgaattggcgggtggtggttccgccggggggccgctggcagaccgaggtcatggtccagccgacgtggtcgaatcgcaaggtgcggacccgcattccgcggggcaaggacatcgagtccagcgcgccggcccgcaagatcgagagatggcgggacaccgcgaccacggtcgagaccgaccacgccgggctggcgcaggtgttgcggcagaccgaaagtgacttgggcgccttgctgattcacgacgccgacggccggggccggccgtacgtcgccgccggtgcgccgtggttcatgacgttgttcggccgggacagcctgctgaccgcgtggatggccctgccgctggacgtggggctctcgatcggcacgctgcagcggctggcggccctgcaggggcggcgcgtcgacgccctcaccgaggaggagccgggccgcatcatgcacgagatccgccgcggaccggccagcgcggacgtgttgggtggcagcgtctattacggcacggccgacgccaccccgctgttcgtcatgctgctcgccgagagctggcggtggggcgccgacgaggcggtcatccggtcgttgctgcccgcggccgacgccgcgctcgcctgggcggagcagtatggggaccgcgacggcgacggtttcgtcgaataccggcgtgccaccgaccgcggcctgatcaaccagggctggaaggacagcttcaacggcatcaacgacgccaagggccgggtcgcggaaccgccgatcgcgctgtgcgaggtgcagggctacgtctacgccgcgctgctcgcgcgggccgaacttgccgagggcatgggcgaattggcgcaggcggcgcagcttcgtgagcgtgcgcaggcgttgcggacccgattcggcgaggcgttctggctgcccgaccgcggctggtatgccgtcgccttggacgggcgcaaggaccgcgtcgacgcgttgacgagcaacgtcggccactgcctgtggacgggcatcgccaccgacgagcacgcggccgccatcgtggaacggttggccggtgaggagatggactcgggattcgggctgcgcaccctggccaccaccatgggcgcgtacaacccgatgagctaccacaacggctcggtgtggccgcacgacaccgccatcacggtgtccggcttgctgcgctacgggcacatcccgggagcactggctctggccgagcgtctggcgacgggtgtcctcgatgcggcagcggcgttcggcgggcggctgcccgaattgttctgcggcttcccgcgttcccagttcgcctcgccggtgccctatcccacgtcgtgttcgccgcaagcgtgggccagcgccgcgccgctgctgttgctgcggtcgtttctgggactcgacccgcacgtgccgaaccgcgccctgacggtgacgccgcacctgccggcggagtggggccggatcgcgttgtccaacctgcgcctcggcgccaccaccgtgcagctcgaagccgagggcgagacggtcaaggtgcagggcctgggcgacgattggcagctggtgacgccgtagcgccgctcaccggtggcccaggccgctcaactggccggccagccatcgctgcacgcccggaatacctgcggccaaacgcattccggcgttgcgcaggggccgcagcgggcgcggcagcgtcgcgacgcgggtgagccgcagcacccgctcggcgcgttgccgctgggcgtctccgtacgcgtcgagcacggtgtccggcccgccccgggcgatctgtgccagcgccgcggcgagcgaaatggcatcggtgataccaagattcatgccctgcccgccggcggggctgtgcacgtgagcggcgtcgccggcgagcagcgccgaaccgctgccgcgacaatccagcgctacctggggttggcttaggcgggcggcccgcgtttcgtcgccggcccgcgtttcgtcgagacttaaaccacgcacacccggcccggcgtgtcgtgtgcgtgatttaagtgtcgcgggcggcgaggcgcgttatcgacggtcagggcaagccgacgcgtcggtagcgccgcaaccgggcggccagccgctcgtcggcgggtatctcgcgcagcgcagccacctcggcggcgacggcgagcgccaaccgtcgcgcgaactcgaccggctcgtcggcggcatcgggatgctcgggcacgatcacgtcgacgatgcccgacgccagcagatcgcgcgaccggatgccttgtgccgcagccagttccgccgcgtggtcggtatcgcggaagacgatcgcgctggcgccctccggcggcagcggggccagccacccgtgcagcgcggccagcacccggtcggcgggcaccatcgccagcgccggcccgccgctgccctgccccagcagcaccgacaccgtcggggtgtccagggtgaccagctcggccagacactgggcgatctggccggccagcccgccctgttcggcctcggccgacaacgccggccccgcggtgtcgatcaccagcaccagcggcagccgcagttccgcggccagggccatgccgcggcgggcctcgcgcagcgacgcggggcccaccaacccgccggtcaggcgctgctggccgagcaccaccacgggctggccggcaaaccgggccagcgccaacagcgtggtcgccgcctcgccctggccggtccccgacaacagcacggggtcggtggcgccgtgccgcagcaacagccgcacacccgggcggtccggccgtcgcgaggcgaccaccgagtcccacgccgcgacgtcgggtatcggctcgggcggcggcggcgcggccagcggctcgggggcgtcggcgatgacggtcatcgcgcggtccagcgtgcggcgcagctcgtcgagcgggacgacgccgtcgatcaccccgtgccgctgcaggttctccgcggtctggacgccctcggggaacggctcgccgtagagctgctggtagacccgcgggcccaggaagccgatcagcgcgcccggctcggcgaccgtgacatgacccagcgaaccccacgacgcgaacaccccgccggtggtcggattgcgcagataaaccaggtagggcaggtgcgcctgcttgtgcaggcggacggccgccgcgatcttcaccatctgcaggaacgcgaccgtgccctcctgcatccgggtgccgcccgagctcggcgaggccaacagcggcagcccctcggccgtcgcccgctgcaccgcggcggtgatccgttcggccgcggccaccccgatcgagccgccgagaaagccgaactcgcacaccaccaccgcgacccggcgaccgaagatgcggccctcgccggtcagcaccgactcgtcgagacccgtcgcggcgcgggcgtcggccagctcttgcgcgtaggccgcgctgaccggcacggccagcggctcgctgtcccagcggaggaaggaattttcgtccagcaccgcatcgcgtagttgaccagccgtgatacgactcacgagacgaggctatatagggtggctgccatgatcggtgttacccgggccgaagccgttttgaccatcgagctgcagcgccccgagcgccgcaacgccctgaactcccagctcgtcgaggagctgcgggaggccgtgctgaaggcgggcgacggctccacccgcgcgatcgtgctgaccggccagggcacggtgttctgcgccggcgccgacctgagcggcgacgcgttcgccgcggactaccccgaccggctgatcgagctgcacaaggtgctggacgccacgccgatcccggtgatcggcgccatcaacggcccggccatcggcgccggactgcaactggccatgcaatgcgacctgcgggtcgtgtcgccggacgcgttcttccagttcccgacgtcgaaatacggcctggcccttgacaactggagcatccggcggctgtcgacgctggtcggccacgggcgggcgcgggccatgctgctggccgcggagaagctgaccgccgacgtggcgctgcagaccgggatggccaaccgcatcgggacgctggccgacgcgcaggcctgggccgccgagatcgcgggcctcgcgccgctggccatcgcgcacgccaagcgggtgctcaacgacgacggcgccatcgaagaggcctggccattgcacaaggaactgttcgacaaggcctggggcagccaggacgtcatcgaagcccaggtcgcccgaatagagaagcggccgccgaagttccagggggcctgacgatcatgcgggggacgcttcggctggtcgccgggacggcgtcgctggccgccggcggttggctggtgcgcgccctgcacggcgccccggacgccctgggcgccgaccccgcgtcgatcgcgaccgtgacgtccggctcgccgcacttccgcgacggcgccttcgtcaacctcgagcccgcctccgaaatcaagatggaccgcgagcagctgcggctgatcgcctgggagctgatcgcgaaccggggcggcagccgtccgccggcggcgatcccgctggcctcaccgggggtcgtcgacgccgaccccagccggctggcggtcagctggttcggccactccacggcgctgctggaaatcgacgggtaccgggtgctcaccgatccggtgtggagcgagcggtgttcgccgtccgacatcgtggggccgcaacggctgcatccgccgccgatccaactcgaagggctgcccgccgtcgatgcggtggtgatcagccacgaccactacgaccacctcgacatcgacaccgtccgggcgctggcccgcacccagcgcgccccgtttttcgtgccgctgggtgtcggcgcccacctgcgccggtgggggatccccgagcagcgcatcgtcgagctcgactggcaccagagcggcaaggtcgacgagctgaccgtgacctgcgtgccggcgcggcacttctcgggacgcttcctggaccgcaataccacgctgtgggcgtcgtgggcgttggccggcccgacccatcgcgcctacttcggcggcgacaccggctacaccaagaccttcgcccagaccggcgccgagcacgggccgttcgacctgaccctgctgcccatcggggcctacaacacggcctggccggacgtccacatgaaccccgaggaagcggtgcgggcacaccgggacgtcaccgacgacggactgctggtgccgatccactggggcaccttccgattggcgccgcacccgtgggccgaacccgttgagcgcctgctcgccgccgccgagccggcgaaggtgaaggtggcggtgccggtccccggtcagcgcatcgatcccgcggccccgcagaaacccgacccgtggtggcggctctgaatctgccgtcgccgcgttagtgttcgcgcatgagcaaacgcgcggcggtcctgacggcggtgctgctcgggttgaccggatgcggctccgcgcagcaaccggccggcgcgccgccgcgaccgtccgacgtcccgcccaaccaggtgtccgccctggcgatcccggccggccgtatcgacgaggccgtggcgaaggtggacggcctcgttgccgacctgatgagaagcagcggcatccccgggatggccgtggccatcgtgcatggcgggaaggtgttgtacgccaagggattcggcgtcaaggatgtgaccagggggcagggccgggacaacgcggtggacaccgacaccgtcttccagctggcgtcggtgtccaaatcggtgggcgcgacggtggtcgcacacgaagtcagcgaccacgtcgtggggtgggacacgcccgtggtttccacgctgccgtggttcgcgctcggcgacccctacgtcaccggccatgtcaccgtcggcgatctgtactcgcaccgctccgggctgcccgatcatgcgggcgacaaactcgaagatctgggctatggccgtcggcagatctgcgagcgactcaggttgctgccgctgcggcctttccgaaacagctacgcctacaccaactatgggatcaccgccgccgccgaggcggtggcggccgcggccggcaaaacctgggaagagctctccgacgaggtgctctaccgcccgttgggaatgacgtcgaccagctcgcggttcgccgacttcctcgcccggcccaaccgcgcggtcaaccacatcaagatcggcgacagctggcaggcccgtttccagcgaaacccggacgcccagtcaccggcgggcggggtgagctcatcggtgcacgacatggcccgctggctgatgatgttgctggacaacggaacccacgacggccagcacatcgcatcgccggaggcgctgctgcccgccctgagcccgcaagtggtgtccgcccccgcgaccacaccgaaggcgcgcaccggattctacggatacggcttcaacacctcggtggatgcctcggggcgcaccgaatacagccattccggcgccttcgatctgggcgcagccaccaatttcgtcgtgctgccgtcggaggacctggcgatcatcgcgttgaccaacgccgcgcccaacggcatcccggagacgctgaccgccgaattcatggacctcgtgcagtacggccagatccgcgaggactgggccgccctgtaccggaaagccattggctggctgaacaatccgctgggttcgctggtgggcaagcagccgccgtccgcccccgcgccggccaggccgctgcgcgactacaccggcgtctacgccaacgactactggggcccggccgtgatcaacgagcacgacggcgccctgcagttgacgatgggcccgcaacaccggaccgccaccctcacacactgggacggcgacaccttcaccttcccgctgaccggcgaaaacgccccgcccggaacggtttccacggccacgtttaccggttcgccggcggccaggctcaacctggagtactacgacaccgaccagctggggacgttcacccgatgaacacaggcctgaccgacgccgaggtggcccagcgggtcgcgcacggccagcgcaacgcggtgcggcagcgcgcgacgcgcagcatcgccgacatcgtccgggccaacgtgttcacccggatcaacgcgatcctgggggtgttgctgctcatcgtgctcgccaccggctcggtgatcaacggcatgttcggcctgctgatcatcgccaacagcgtcgtcggcatggtccaggaaatccgggccaagcagacgctggacaagctggccatcgtcgggcaggcaaaacccatggtgcgcaggcaatccggcactcgcgctctgcctcccgatgacgtggtgctcgacgacatcatcgaactcgggcccggcgatcaggtcgtggtcgacggcgagatcgtggaagaggccaacctggaggtcgacgagtcgctgctgaccggcgaggccgacccgatcgcaaaggccgtcggagattcggtgatgtcgggcagtttcgtcgtcgccggcagcggcgcctaccgggccaccagggtcggctcgcaggcctacgccgccaggctggccgaggaggccagcaagttcaccctggtgaaatccgaactgcgcaacggcatcaaccgcatcctgcagttcatcacctacctgctggtgccggccggcctgttgacgatctacacccagctgttcaccacgcacgccggctggcagaagtccgtgctgcggaccgtgggcgcgctggtgcccatggtgcccgaagggctcgtgctgttgacgtcggtggccttcgcggtcggggtggtgcggctgggccagcgccggtgcctggtgcaggagctgccggccatcgaaggtctcgcccgcgtcgacgtggtgtgtgcggacaagacgggcacgttgaccgagagcgggatgcgggtcgcgcgcgtcgacgagctggacgggtccgggcacgatcggatcgccgacgtgctagccgcgctggccgccgccgacccgcggcccaacgcgagcatgcgcgcgatcgcccagacctattcccggccgcccggctggaccgtcacggcgacagcacctttcaagtcggccaccaaatggagcggggtgtcgttcgccggtcacggcgattgggtgatgggtgcgccggacgtactgctcgattcgggttcggcggcggccgggcaggccgaacggctcggggcgcaggggctgcgggtgctgctgctgggtgccgccgaccgggccgtcgaccatcccgacgccccgggcccgatcaccccggtggcgctggtggtgctcgaacagaaggtccgccccgacgcccgcgagaccttggattactttgcggatcaaggtgtttcggtcaaggtgctgtcgggtgacaacgccgtctcggtcggcgccgtggccggtgaactggggctgcacggcgaaacgctggacgcccgccaattaccttcggacctggcgcaattggcggacatgctggacacctacaccaccttcggccgggtgcgccccgaccagaagcgcgccatcgtgcacgccctgcaatcgcacgggcacaccgtggcgatgaccggcgacggcgtcaacgacgtgctggcgctcaaggacgccgacatcggcgtggcgatgggcgccggcagccccgcctcccgcgcggttgcccagatcgtgctgctggacaacaggtttgccaccctgccgtatgtcgtcggtgagggccgacgggtcatcggcaacatcgaacgcgtcgccaacctgttcctcaccaagacggtctactccgtgctgctggcgctgctggtcggcttcgagtgcctgttcgccaaggcgctcaaggccgatccgctgctgtacccgttccagccgatccacgtcaccgtggcggcgtggttcaccatcggcatcccgtcgttcatcctgtcgctggcccccaacaacgagcgcgcccacccgggcttcgtgcgacgggtgctcagctcggcgctgccgtcgggcctgatcgtcggcgcggccaccttcgcctcgtacctggtggcctatcacggccggcacgccaccttccagcaacaggatcaggcctcgaccgcggccctgatcaccctgctggtgacggcgctgtgggtgctcgcggtggtggcccggccctaccagtggtggcgggtggcgctggtgatcgcgtcgggcctggcctatgtggtgatcttcagtctgccgctggcccgcaaggcgttcctgctggatccgtccaatgtcgtggtgaccttgtccgcgctgggcatcggtgtgctgggcgccgccgcgatcgaggtcgcctggtggattcgggccaaaatgctgggtgtgcggccgcgggtgtggcgctgagcacagcgaactcagctccgtcggtggcgggcagtacgatgccgtggaaaagggagggcgtaatgggattcctggacaaggccaaggacctgttgtcgcagaacgccgacaaggtcgagatggccatcgacaaggccggcgagttcgtcgacgagaagacccagggcaagtactccgacaccatccaccaggtgcaggagcaggccaagaaggccaccggcgccaccgagaccggcgaccagcagggctgagccgtggccaagctttccggatccatcgatgttccgctgccccccgaggtggcctggcagcacgcctccgacctgtcccggtacaaggagtggctgaccattcaccgggtgtggcgcagcaccttgcccgaccagatcgacaagggcaccgtcgtcgagtcgatcgtcgaggtcaaaggcatgctcaaccggatcaaatggacggtggtgcgctacaagccaccggaggggatgacgctcaacggcgacggcgtcggcggggtcaaggtcaagctgatggccaaggtgcagcccaaggcggacggttccgtcgtcagcttcgacgtgcacctcggcggtccggcgctgttcgggcccatcggcatgatcgtcgcggccgcgctgcgcggcgacatcgaccagtcgctggagaacttcgtcacggtgttcgcccgatcggatccgagcaccaacggtcatcgctgagcgcgggcgccacgctggggacgacgttcactgccggggccgacgccgcagtcggctagtctcgcaccatgactcgccgactgcgccccggttggctggtggccctttgcgccgtgctgatttcggccagcgcgtggctgccgtggctgcggacgacggtcaacggcgggggctgggcgaacgccatcggaggcgcccacggcaacctggaactgccgcggggcttcggcgcggggcagctcatcgtgctgctggcctcgacgttgctggtggccggcgccatgatgggccgcggcttgtcggtgaaggtggcttccgttgcggcgctgctgatttcgctgctgatcgtggcgctcacggtgtggtactacaagctcaacgtcaatccgccggtgtcggccgaatacggcctctatgtcggcgcgggcggcgcggcctgcgccgtcgcgtgctcgatggtggccacgatcgcggtcctggtctctggccggtcgcgccgctgagccgtcaggccgacgggaactcgtggtctgcgggcgtttcccgctccggtaggggtggtggtcgtcctcgggcggggtggacagaaatgtggcgacgatcgtcatgctcggctgccttcgcccaaggactgctccggtggcgatgcgagcaaaatcgtcgcggttagcgccgataatcggccgaccgctcgacccgtgcatagcccgaacgctacccccgggcggcgccgttgttgaggcctagcggcgagccggggtgctcggtggggattcgagagggtgggaaaagggcggccccgtcggctctcgggctgaaccgacgggacctagacgggcgcgaaggccggccgacgcgctcgtctctgatggatcattgccgccgatcatggtcgacaaacatgatgacccaatctctttgagtgtgccacgacgccggcgccccgttgggttaacgacgattcgtgtttcggcgaggcgccggaaaccgtcgagcatgcccgcgacgggaagcctgagctgcgacgatgtggtgcgcttgtaccgatgcggagccggtggcgacacggtggggtcacgccgcgtctcggcgccgcatccgtctgcgatgcgggccggcacgcgcgggcgccggccgcgcgttcggcagccgtccagcaaactgtgtgcacggcgcgggcccggcgccgggcgggcgaccgccgagcgacgaagtgcccgccttctagcgacaaaccggcggccggcggggcgggcggacgcgccgccgatggggcccatcctggcaccgcgcaccgcatcgcccgggcacccggccactccactgttggcgaacactgaaagcctcgtcacctgcgtggatctgccgctgagttaatctctagacctgcgtcgcggccggggagccgacgcattgcgacacggtcacggatgcatacctatcagctcatcactggtcacatttgccccgctgctcactatcgtcacaggagccaactatggacgtcaacgcggtgtccaaccccctcgaaaggtgttacatgtcggcgtttctgcgaagtgtgtcgctatcgatggcgtcggcggccgctgtcggattcgtcctcgtggtgggacccgcgccaaccgcgaacgccacaccgtgtggggctcccgaagccaacgtggacccgcccgctgccccgccggcgatgcccgcaccgcagccggttgtgcagccgccgaccggccgcaggcccacccacaccaacgaccaggcgccgctgcccaagctgggtccgctgatctcgtcattgctcaagccgagcgcaccgggccggcagtactccgcaccggtgcacccgcgggccgaggggcccggacccgacccgtccgcaccgatgtatccgcaagccgaggtgttgccgccgggacccaacccgcccacacccggcggggcggtaccgccgaatgccaaccagctgcgcccgaacgccgccccgatgccgcagccgcagcctcagccgcaacccgcgccgggtccgccgcccccgtcgatcgcgggcgccccgacgtcgctggtcgactgggtgaccggacccaacggcccgaacaagaccctgcaacgtttcagtatctccggcaccgacctcgggatcgcttgggacaacggcgatcccgccaaccgccaggtgctgatggccttcggcgacaccttcggctactgcaaggtgcacggccagcaatggcgctacaacacgctgttccgcagcaacgatcacgacctttcgcacggaatccacatcgccgacggcgtgcccaacgacaggtactccggctcaccggtgtgggcgcccgggctttccaaacaggtcgtcaacaccatccacaaggcggcgcacgagaccggcatcattcccacgtcgggcatgtcgatgggcagaacccaatacatgagctacatgtccatccgccagtggggccgtgacggcgaatggtcgaccaactactcggcgatcgcacggtccaccgacaacggccagaattgggggatcttcccgacctcgattcgcacggcgtcgccggatgccattccgggagccgggtttacgcccggcaacgagaacttccagatgggcgcgttcctcaagggcaacgacggctacatctaccagttcgggacgccctcggggcgcggcggggcggcgttcttgtcccgcgttccgccgaaccaattgcccgacctgaccaagtaccaatactggaacggcgacaacggcgggcactgggtggcaaacaaccccggtgcggcgacgccgatcttccccggcccggtgggcgagatgtcggcccagtacaacagttatctcaagcaatatctggtgctctacaccgacggcggcagcaacgacgtcgtggcgcggaccgcgccgaccccgcaggggccgtggagtcccgagcagccgttggtgtcctcgttccaaatgcccggtggcatctacgcgccgatgatccatccctggtcctcggggcgagacctgtacttcaacctgtcgctgtggtcggcatacgacgtgatgttgatgcacaccgttctgccgtagagctgtcccatccggtggccgagtgagaggagggcgacgatgatcgccttggagtatcacgacgacagttgcggcctggccgacccgctcactccgctcgccgcggcggcgctgcccgacgacgtgcccgcctcgtcggcggcagacgtcaccgggcgccgggacgacgacggtgcggagggccacacggtgttcgacggtcatcgcccggatttctggaccataggcaggccagggctgcgcgacatcgaggtgtgcatcgagagcacccgcgcggatggcgcgatcagcctgggcctggtggtcaacggcctggattgcagtggtgttccgattgaccaggcgctttcgctcgcagacgcccggggggatgcgggcgtctgcggcgtcagctgccggggaggcgggcacctcaaggccagttaggccgcggcggaacgcatttggtgcgacgtcgccgtcacggcgggggcaacgggatccaccgcttaccgtccgtcgtccatccgcacggcaggtagttccagtgcgcgggcgggccgaaatcgaaactcaggcacttcggtgccaggggtggcggggtcggcgacggcggtgccggctggttctcggcgtgagcagtggccccactgagagtcaaggccccaacggcgatcagtgtcgcgactagcttccgcatcgcaggcccggcaggtgtcatgccccgacgaggcgacggccgctacgtttcttcccgcacacgcacgtcaccgatggtagtcctgtttcccgcggttggtgggacgtaaagtgcttcagacccccggctgttgggcggcgggcggccgggcgaattaaccacttccaccgccggcaaacgatttccaggatcgccacgacgtcgccgcaagccggtctgcggagctcgctcgttcagcgccccagctcaacatggctgcggtgcagccacgcgatcaggtcgggcggccacaactgcgtcacccggtctcgatatctggcgaggtcgtcggcggtcatcagctcgcgtgcggcgccggagctgccccggcggaaaaacgccgtgccgagttggtccgtgaggacccttctacgcgatggaactccttgtgacggaacggattacatcttcgtgttacggcgctggtctaacatcggctgcgccgcccatcggccttaggtaaaccaggcatcgtcgcagtagtggattgcatcatgtggcgcgatgcgcgctcagtctgtcggtgtccggtgagagcatcggtgatatggaggaggagtttgagctacccgacggccggagggtgcggtccacccagcgggcgctggagaaccttgaggatcatgatgactgcccgttctgcttggggcgcgccgcggcgcaccgcggtgacggcaatgattcaaacccgttccccgaggtcgactttccaccaggctcggcgcagcggtacgaagacgaccactggctctggggcatgggtcactccgtcggttccacggaaccaggcggacttctgtggttcgaggagccgaaccgtggtcatgacgcataaagcaccacgattcgccaaagggggatgctgggccgatcggccggctggcgattttgatttgctgtgcttgttatgtttagaggcgtgagcacggtacatcgcagggcgcgggactcggtggagacaccgtagcccctgtccgccctcacccgggggtagcgggcaggggctcagtcccccggaggttttgccttgtcccgcaccgatgcccacgttccgctctgggtgcgtctcgcccgtggcgatcttgacgccgaagcgcagcacgcgttcgatcatgccgtttgtgatcttcccgagcgacccccttcccggtgggaaggctggttgccagcgactcggtgccgttggatcctccgctacaccggcaccaacatctgctcctgtgctatgtgtcacgcggggccgcagcaccgtcaggagaatcgcaatcaacgccatcgcgaccgcatggcgttgcgcgccgcgcttggccgctggcgcagcggcgagcagtcggctttcgacgacatcgctccgccttcgcgcgtgtattactggtagcgcctcggtgagtggcggccgctacggattaccgccaccaagcagtgtcgtgatctctcacagcgtgagcggacgatcgacggctggcagctatgtacggcttgtgtcaccgatcagccgaaacaactgtcacgcatcagccgaaacactgtcaggcatcacccgaagccgaaacgtcaagcatcaaccgaggtcatacaacagacaaagtgcccctgttcagagtcggttgatgggtgacatttctatgtcggttgatccttgacactctgggttggttgtgccccgtgaagtggtgtaaagccgatcggcgtttcgcctgaggctctgcgagtttccactatgccgtgatggcggcggggacggcaacggattggtcggctgaatcggagcggggatgtaatagggccagggtggtctcggagagatagcgcttttcggcgacttgccattcgtcgtgggcttcgacgagaacggagccggccagccgtagcagcgcggcggggttggggaagacgccgacgacgtcggtgcggcgtttgatctccttgttgagtcgttcgagggggttggtgctccagatctttttccagtgcaggacagggaaatcggcgaatgcggtgatgtcgtcggcggcctcgcgcagcatcgtttcgaccttgggcagttggcggccgagcatgccggcgatggtgtcgagttgctctcgcacatgttcggcgtcgggttgggcgaagatggtgcggatcgctgcggcgaccatctcggctgatcccttgggcacctgggcgagcacgttgcgcaggaagtgcacccggcatcgttgccaagatgcgccgatgaggatggcctcgatggcgctgcgcaacccggtgtgggcatcagagatcaccagctgcaccccggacaggccgcgggttttcagtgagcgcagaaacgccgtccaaaacgcgccgtcctcggagtcaccgacgtcgaagccgagcacttcacggcgtccgtcagccgcgacaccggtggcgatgacgaccgcttgggagaccacccgatggttgacccgagccttgcagtaagtggcgtcgaggaacacatacgggaagtgctgttcggatagaggccggtcccgaaaggcgcctacctcggtgtccagatcggcgcaaatccgggagacctcgcttttggagatgccggcgtccgcgccgagggctttgaccaaatcgtcgactttgcgggtggaggtgccgtgcaaataggcctccatcaccaccgcgaacaagcactgatcgacccggcggcgccgctccagcagcgccgggaagaacgagcccgaccgaagcttgggaatccgcaactccaaatcgccagcgatcgtcgacagtgtgcgcggccgagacccgttgcgctggttggttcgtgatgcgctccgttcatgcggaccggcgccgatcaccgccgtcagctccgcatcgatgagtgcctgataaatcgtctcggcggcctgcttgatccgatcagcggcatcggcattgcgtaatgcgtccagcacctccagcaaggcagactggtccagggccatcgcgatgttcctctcggtagtgatccttggtcgtttcaccacagagactcacgcgatggccctctacatcagtaccgacacgccgccactatttacaccacgccccggcacgttcccccctgggttagtggttaggcctgttcgcgggtgcggaaggcccgtttgtttcttacctctgcatggttggtgcgcgcagcggtcttgactaactggtcgccgatccagaaccgcagcagctcaccgtcgacgtggacatcgcagcgggccccggcgtagtgggctcccacgcagacctgctgccaggccacactgaccaccccgttggtcgttacccggcggctgacccagtcctggccgtctcggtcgatgctggcgggtacgtcgtcgccagggctcaccggcgaggcggtggcggtgaaccgttcggctggggtggtcatgttcagcgattgatgcggacgggcggtgttgtagtagtgcacccattcgtcgagggcttgctgagccgtcttcagatttgagaaagcccttgtgttgctgaggaattcggcgcgcagactgcggtggaaccgctcaatcttgcctgtcgtcgtcgggctacgcggctgggtgagcaggtggtcgatgccgttttgccggcagatcgcgtcgaagagcacctccaccgggggatggttaaaccggccggtgaacaccttgccgttatcagtcaaaatctgctggggggccccgtaagccgccagcgccgcccgcaatccgtcgcaaaccgcgcgggtacgctcacgcgccatcaaccgcgcgcagacacacatccgggaatggtcgtcgatgccggtcaacgctttggcgctggtgccatcggccagcgggaaaccccccaccacatccatctgccacagctccatcggggcgccgcgttcccaacgtttccacttgcgcgaacgccgatcccgcaaagccggatcgatcatgcccgcccgcaccaaggcccgatacaccgccgactccgacggcaccggacccacccgacgcttagccagctcgaacaccagccgccgtggtccccagtacggccgcgaccggcgccgctccaacagggcggcctccaccacggccggcatctggtgcggacacgacaccggccgatgcgaccgatccaccagcccctcaaggcccgacgcctcatagcgggccaaccacgcgtgcagcgtctggcgcgacacgcctaccttctcggcaaccagcgaaatcgacaacccatcgctgatcaccgccaacacggcctgatacctctgctcggccacggttaactccttcatcgaaggagtgtcaaggatcagccgaagtaactgtcaagcatcagccgaaacactgtcaggcatcacccgaagccgaaacgtcacacatcaaccgacgtcatacacagacaaagtgcccccggcaggattcgaacctgcgacaccggctttaggagagcctgcaagccctcctagtcgtggcctcgaaagtggtcctgaactggcgatatgacgccatttcgtaccacccgaaatcacggcgtgtcgcggattcaccgaccaagcaccgaccacagatcagcgttgactttcgggctcagaaacgagcgaagcccctcggctgcaaccaaggggcttcacggaggcaacgatgaaaaccaccgtttgcgcgcgcgatcgaatcgtaccgcgggcacacatttacgtcatcgatccttcgaccctcggcggcgcgaaatgacgccgggaggtccgcaccgaggcggccgaggggagccggacgaccggggagcaaatcgcgatgcgctgagtcatttcttcgccggtcccaccgatgacgatcgtgcacggcttcgggccgacttgctcgctcgggctgggcaggtccgcgcgactggctgggagccctaccacgggctctggtctaccggggaagtgatcggtgtggcgttgctgctgggagatcatgctgaactcgccgctctcggcgagaccgtgcagtcagcattggagcgctgggcgttcgacctctggggcctggatggaggtcaggccgacgttgacgacggctgcgaagaaacccgtgagtggttcctggatgcggcatacgagttcggcggccaggaagcggtgcgcgaacgatccgaggaaccggcggccgaagacatccccatgtcggagttgctcgccgcagagtctggccatgacgttgactttgatcccgaacggctcggcgagctcgccagcgacgatgcgctgcgtgaacaattgagtcgcgcagcagagtcaccgaccgtccgaagggcgcgacctcgccgttcgtcgtattcagatcccagggacggtgccaaatgagtccggtggccgacggttggtcagtcgatgtccaggggacaaccgttgttgtgactttcccgcccagcgacgagatgggacggcgttcacttaccgtggatgaggcacgtgtgctgtgcgaacagctcggttttgcgcacctactcgcgggacgtaatagggcaacaggggacccggacgttgatgacgtcgatgcggatagagccgctggcagtcggctgattgatgatgccttgcatctcgaacctgttgacgtctccgatgaacatctacggaagttggtggattactttcgagcgcgccgccaagcagcccaagtcgccggcgccgacgatgcagcggaagatcaggcttgggtcgacgacatctcgcagttcaacgacgacgatttcgacgcccatcaagatttgcctgcaggtggtttcccgatcgctgatcaagagccgagcgagaagcgtggtgaccgcgtagaagaccaggctgcaccggcggatgaggacggtatcgccaatgcgtggctcgatgagtgggaggagaagtgacgcaggctggtgaccgacgggtgttggtaaaacctttagtaacgggccacgtagtaaaggttggcggcgacaaagttaattaccgcacgtcgttcgaacgctcaggaggcgacgcggagggccagagcgtcgctcttggtgatgaatatccgaagcggtgtgggggcggtcgagatgaacggtgacaggaatcttcctgaaggctggaaggtctatatccgcggtgggtccgtggaagtgaaagcgccggcgtcgggcgggacttctaccggttatctactgacatcagttgaggcccggcgtctcggtacagagattcttcgggcgttcggccagtgtgacggtgacgggtcgattaccgcccagtacatggacccgatccggtggatcgtctcgctaacgggccgcaacgtgtggttgagcgtctcacctgctgaaccagatggtcgatacgtgctaaacgatgtcgagtcaggcgggctcgccgtgatgttgttgcaagcgtccgtgatggtcgagcagcttgactcagatgcggtggatggacctggaagcgaactgcttgagaagggctttcgggaaatccaggccgggacagagcgtcattcaactgagatccgttgcttgacagacgaattgaataacacggaccctaaacttctttctgaccctcgatctggtgccgacgcgtcggaggagggcggtcgtgatgatgtctgatctagacgaggtgaggacgtcaatcgatgccggcctggcggcccgtagcgccggaggcgcggagggccagagggccggcggcgcgagcgtagcgagcgctcttggtagtactcagagttattgcttcaccacatcagcgaccagcggaggcggggtttcggcggttgatccgggggagcggcgccggattcgttggggcgcaagggcgatgctgtggcaggcgtcttcgttgaaggcggtgcgctgctgtggccgggtgttgcataacgatgcggttggcgatcctgatgacggtcagggcgtggtgattaagcgtcgggaggttgatggacggatggtggcgagtctgcatggtctgatgacttgcggttcggtgtgggcatgcccgcgttgctcggcagtcatagcgaataccagggccgccgaaatcggtgcgacagtgagagagtgttatcgtcgtggtggtcgcgtgtatctgttgacgttgacgatgcggcatagccggagagatggtcttgctgacctctgggattcgctttccacggcctggcgttcggtgttcggaactcgtaattggacggggcagaaagaacggatggtgcagcgcaggcgtggcttggcccttctcccggagatcatgggtgatgccgagcgtttcgacatagctggcgtcacccgggttgtggaagcgacttacggcaagccggaacttggtgggcatggctggcaccttcatatccatgccctcgtgttctcagtgaccagcttgtcgagcggtctgattgagggcattgagcggactctgggccgcggagttaatcatgattggttggcgcgcaacgtctttgctgctcgaatacatcagcgctggtcgcagggattggccaaggctggctgtcagatgccggggtcggtcgccgttgatgtccgagagattgacgacgagggcgctgaatacgttggccgatacctgtccaaggctacatatgatgtcgcggcacgcataggtcttgaggtgggagctggcgtttcaacgaaagacgctcgggcagaacgtaatcagactccgttcgaagtgcttgcgaatctcgctgagtcggtggatgctcgcgggttcggaattcggaccccgcgtcattgggctgttctccctgcaggaaacggagattgggctgtaatcgacagtgatacaggcgaagtcgcgagcatcacggcgcctggacagtggaaggtatggcatgagtgggagcaagcgtcgtgtggtcgtcgtcagattacttggtctcgtcgacggtcaaaccctgaatcgggccgcgagatgctgtggaatgacttgttggatagtcgtggacggtcagcagaagcatcggacgaagaaattgcggtcgatgaggtcgatgccgagtcggtcggcgttattagtcgacaggtttggtaccaggtgtttgcctggcgtccagggttgattgtggatcttctggaggcggccgagcggtgtggtgtggcggctgttggtgtgttatcgcaatctgctggttgtgacgtcgccgggtggccaccaggcgggtagcaccaacatttacgcggcagaaatgtgttccaaccttgaccccctacggattgtcggtggctcgtgcgagcctatgtatcgataactttgaggaggatgggatgtcgtatgttgtgcgccgaattactctggacgagttatctgctcctcgcccaacgaagcggatatcggttggttgggccgatgggctacttaacggcggtatgcccgcacggaagttcgcgatgatctacggacaacctggtgtcggaaagtccacgctaaccgtcgagttcgcttgtgccgctgctaaaatggttactacggtttacgcggcttcaccggatgagcatgacccgcccgacgtgcgtagtcctggcgatattgtgcggctggcccaccgaatcgatgccccgctcgcgggggtgtatgtggtgaccgtggatacgattgacgacgccatcgcggcggcaaccgaggtgggtgcgcggatgttggtcgtagattctgtgaatgcgtgtgcggatttcgatgctcggcggatgaaggcgggcatgcggaagttgcgggcgtggtgtagggataacgacgccgcagcgatgggtgtgggtatgtacgacacagcgggtcggcgggccgggggctacagcgttgcctatggcgctgacgcaatcctggaccttgacgttgaacaaactccagagcgtgacaagctcgctgagttacttgtagatgaggagatcccaaccgaggacttgtcgctgcgacggctgaccctctggaaatgccgatttggcccagtaggtcagcaggtgttgcggatgaccggcggtgggctcgtaccgcacgaacggccaattgactcggggctccgccgcctcgttgaccaatcggaagagcacaacgctatcgcggaggtcaaggacgatgatccgccaacgcggtagtaatccgggtggtattcatcggccctgcgtaggtaggttaggtccatagtcggcacaattgctggtaaccgggagtttcgctgagttctcgataggcggctgagttatagcgccatgccgtgaatgctgggtgggtatgtagctgaagtagccattttctaagggccgcggtgtccgtatgcgatgtgaagtagtgcagcgcatcgctgtagtggctgggaatggcaggggtgccaccgtgcgcagcgcgccgagcgccggctcgatgctcacgaaggcattcttggacaaacggccacaccattgcgggcacggggtgttcttgcccctgctgccagatagcaacgcttgcctcggcctctttgcggtgtgtcagctcccataaggcgacggcgtattgttcgatgagttcgtcgcagagatcgcctatctgggttcgtagctgtgaatttagtttggggctcatgtattggaccgcggatatcagtaggtcagttgtactggattcgcatattagtgcgtgagctgacaggcgccaatgaactcgctgcagctggacaagcgttttgtcggatatgggggtggtgagagccgctgtcaactgattggtgctgtgatgttttacgaccccgcggtgcccggacggcggttctccgcgccgctccgcccgccattgccggccggtaatgcaaggtatctctccctgaagctgcgcgatagcaacgcggtcaaaaggcagtgattcgggctgactacggccggttactacccgtccggcggccaccagagcggaccacaacgccactgtctcttggcaatcgtggattggatcttctttccagcgcacgggcgtagtgtcaaccggcatgccccatatggttgtttctccggccgccttgctccggaggtggccggtgttgagccgcaggagttcgctgagccccaggccgcgacttgaccggattcgtggtcgccgcgcgaactccacccgcagtagaatgtcttgagtatcaacggttttgccgatcaattcgtcagacaattcgaccagttggccaattgcctgatagtcgccgttcaagaggttgtgtcccaagactcgatgcacctgcgcggcgacttccagaaactttcgggcggtggttgttccatcgaactgttcttgtgcgattacacagaagcttcccgtgtccggccgtacagcggcaattaacgcggcaccacgacggagtacccaagcttgtacgggccgttctcggggtctttggaactgtcgcgccccttgtctgtcgctcttctttaggtagtcgaaatccacacacgcccaaagctgggtgtttggatcggcgccccacgtgttgatgcgttgtttagcaagttccagtggaggcacgtcgagatcgctgaatccctccccatcaaggagcatctcacgctcgttgagcattgctgtatcgatgcccaagccagccaactgcgcaagtgcatgcgtttgcgtgatcggctcagaggcgcgaatctcgtcggaatctcggtgaaggtaggtccaatcggcactgcctccggtcgtacgagcaaataccgccacccaaacgtatcctttgcggtacaaagcggaatggtcagggtattcccccgtgtcctcgaacacccgcatcacgccggcgatgtctggccgccagtaccaccccgctctcatagtcgaggttctagcatttagcaccgacaaatacccgaagaggatcaagtggcaacctggccgcattggcggtcttgggttggccggtgcttatgagtaatcgcgcgcgccgaggctgtgcgggtgggggcaccggtgccgcgagggctataccctttgtgggctcaacctgcaacgggtaaggtggtggaatgagtgagatgatccgcactgacagccgcggtcgcgtcacgctggctggccacccggactcggcctatctgctccgcgaggaaccgggcggggtgctggtgctggaaccggccgtggtcatgtcggcggcccaggcgagctatctggcgctcccggttgccgaccgtgcgcgtatcgaggagttcgtcgacgacccgtccactgctgtgaaacgcacgtataagcggcgccggtaagtgggcatcgagtacgcacccgaagctgctgcgcagctcgatgcactggagcaatctgccgacgatcagacctgggacgcgatctgcgacgtgctcgaactgatcgaccagaccccggacagtgcccaggcccggcgcgaagaaatcacgggatcgaacggctcgaagatgtggaaggtgcccgtgcggtccttatccgtcgacgatctcgccgtgttgtggagccgcggctcggctggtgactatgtggtgttcgtcggcgtgatgccgatcgcgaggtaggggcgcacccaaccgaccagtgacgtagtgcgctggacacggcgcaagccgaggtcacagacgctgacattcgcgatcgaagccaggtgccgggagtgccactacaaggcgacggagcgtgcaaaggtcactacatatccggccgaacgcgtcgctgatcagcttcggccaacgccgcctgcagtgccgtcaaaattcggcgggttgtggatcctcgctgtggtttcggcgtccaactcgtcgacaccggcgattagcccttcagcaaagtgctcccggagcgcggcggtctgccaatcgtcgtcgacagcgccgtgcatccgcttacgcagttcgaggcccagttggtcgcgagcggattgttcacttgcgccgctgacgtcccattccgcgccagggtatcgcgccgtccatgatcggtcttcgtactccgcagtttgcgggacgaacgcgaaggctctcccagtggtgcgcatgaagtcttccaaattcgtgctgcggtcttcggtatttgccatcagttgtcccctgcgacatccgtgcgatctttctgaattaactcggcgatcacgttgagcgatacaggcgaaagaccccacgcatcaaggccaacatggatggtgcggccagcgagtcgccgtgaactgtggatatgaccgtgcagcagccatgcgccgagatcggccatcttccactggttgaaccgcgcgtcgcgcacgtcttgttgatcagcgtcgaggtacgggaagtgcgagagcaagatgtagtgcccggctaacttgcggcgcgctgactgctgaacagaagcaaatgtctgtaggtacgccgggagcaatttatgcgcatcgacgtgcatcggatggacaccatcgtgattgcccgccaccaagtgcttggtccccgggcggtccgcaagccatgcgagcgcacgcagctgactggaccgtccgccgcccgagatgtcaccgagaacccacacgacatcgttgtcgcctacgagtcggtcccatcgttcagcgatctcggcgtcgtggtcggtcgtctcggcaaacccgcggagattggctacgagccgatgaccgatgtggaggtctgaggtataccaagtttcggttctgagcgtcattttcaggtctacgagatcacgtgggtcagccgacgtgattcacggtgaatcaccgcgtatgcctcgtgggtcggtggctgtccagtaaggatcggtccaagcgcggcgttctggagacagtgcgagcgttgtccgacctggtgcaagttggaggatggcaaagctctcgtcgattgactgccgaagtgcttccgttgcgtcagcgtagtcagcgagccggccgagtagcgccttgcagtcggtcacccattcgtctttcaaccgatgggtctgggttcggccgagacgggcggcgcgcttgtagattgttcgtggcgttcgatttgtaccgccggaggagtggatatcggtgactccgcaaccggctagagccagcgcggagtccatcacttcggtggcgcgggtaagcatgcggccacgggattctgtcagagcaaggagcttgccaaagttggctcgcagaacttcgatcactgaatcatgttccgacacaagttttatcaaggacctagagcccaagaccgaagacgatgccgcgcgtacgattcgatcgttgagttgtgcaaggcgttcgcactcaaccttttgagttccacaaagtgcgccgattgcactccggttggcgtcgaggtcggctcggagagaacgcaattgaagcgtggccttttccgcgaacctggccgcgggcgacatcgccaacacggcgagggcgtcttggcggatgtcgtctctggggtcgtagtaagcgcgcaccgcgtcgcggcggatctgcggtagatagagcttcgcctttgtgagcgcggttcccgtcagcgcggacacatgtagaagatcgctgactgttgcgccggcctggaacgctttggcgacgatatcgggcggcagcgcaggcagcacctgggatatgcggacttccagatgatctgtcatagggtgagtgtaggtcgcagcgccgacacggccaacagatttagtcctctacctggggctttgaatacgtaggcacgccgctggcacgctgtccgctcatcgataactatgggtacatgagcacgttcgaccgtaccgggtgcgccatcatatttgggtgtcagttcagcggaggtcatcagtgcacctatcaggaaactggtgtggccgcagcggacgtacgccgattggtgctcccagttggcctcgggtttcttcgaggtggtcgatgatgtctctcgatcgaccttgggattgcgaaattcccgacttccaccttccgctgctctcccgtgtacgagtttcgatgacccgagcccggttcgagctccgtacgagggtcagtattccgctctggcaagtgctccttgtggtgatcgtcgttgcccttgtcctcggcctgcttattgggctggtgaccgtcgaccaggtgtacggctgaggcgttgggacgagatatggcggcgaagcaacaagagattcgacttgtccatgagcgctacggtgtggtgggcgcggtggggggaggctggcgatgcgcttcgtaaacggcaaaccgatctggagtccggtaaccgaggagctgcggagcgcggagttacctcttcgattgtggctgtctgcgaagcttccgaacgtcaagccctgtttcgccgagttccggaaagcaattcggcacagctgtatcgagccaccgacgggccttccgactggcaccgccggtgcggcatttgattacctgctgcggtacaggctaggggctgaagatcccgccgagctagcggtaatcggctcggcgcttacggatcagaagcgcgactggacttcgacggtagtgaacctagccgcagagcttcgagatatcgcaagtgtgtggaaaacgtcaggtcagttggatacctcgcaacctccagcgaagctcgctgaaggatgttgggcactagcgcttttcacagaactctctcgtggtgtgcctttcgaacggtcggccctaagatccctggggtctgaggtgtctacagatgcgttactgatgctggctccgcgatccgggatagacgatcttgcgcggctctatctgtcgagttcgaaaacgttgtttccctacctgtctgggcgtcgtggcactgtggtcctggggccgacgttcggagcatccatccctggtgacgctgatttgatcaagggaacgactcttgtcgagttgaaggcaaccgtcgaccgtcgtcgccgtgacggcactccgcggtacagcctagactcgcggactctttatcaaattgtgacgtacgggctactggggcagaacgcattcgggctgaatgaggtagcgatcttcgatgcccgctattctcatcttcaacgatggtcgatatcggagctcctctgctcacttgcgggcgagagagtgtacgtcgctgagctgtcgatggaactggatacgtttctacgtgacccgtgcgggtcacgggtacccaaccttgcgcgtgaggcagctatgaggatcagcgccgaaggtgaactgcctgcgtctcggcgccgtcgtgatcggtttacgaggaagccaccggcgaagacaccaccatcaccgtcgaaggcaaatctgtggcgcgcctgaggccccgtcagcctccacgccgccggtggatccgccgcgacgagttgctcagccgactcgaaggtgcccaagccgacaccggtctgcgccacgaccttaatgcgctcgccggcgacaccacggacgacctcgggcccatcaaataattcgcatttgtgaggacattcggtcggtcgcggaaacctgccaccgcaaggtttatgttcggtcgactgttgatcgctaagcctgtggtctgtttagctgcatagcaacatgtttcgccaatcgggcgcttacgactatcgacggttcgatgtatccgacattcgaattcccgttcttacgtgcggttttgaacgagccgaagagaagctatgccaccggttcctactcggtgatgattgttgcatgaccgaagttgcgcgccgtgagactctcatctcccatggggatctctacgatccgaaacccgttaacgagatccaacccaccggatttgcgccgtgggatctcgccctgggagggcatcgttcgtgtgggaggccctcgatcactggacatggctttgatgactgtcgcggcccatccgaatacccacaacgatgttctcatcgtgggtgcaggtagatcgcggcatgtgttggcgcgctttgctttgcgtgcgggactcgtggatccgaagctgttggtgacgaatgattgcgaggcggtgacgcaatcggtaagggtcaacagctggcgctatgtggtcatcgactgcgcagaactgatgtctgcgtcgcatgactccatggccaagttggaccaggcttgttgcgacagtggcacaacgctattcgcttgtgatggacctgctgaatctcgtgcgtactcggtcgacagactgacgtggagctgcgcggtccaatcgctgcgtctcgtcgaggagatgccgagccacgcaaatggagtcttcgagttgcgcgtggtggacaacgtgccggctcccgacatcgtatcgaactcggttgtaagggtgctcataccggcgaatggccgtattggactggctgattcgggcgacgacgaggaggggccactgatccttgaactacgccagtagtggcaatcaaaagcactgttacgaaagaacgaattgaggaaatcaaatggctgacatcgcgagactgacgctgaacgtggatccagcatctgtccttctcttgggtaccggtggcacttcccggacaagggcggcatacgagaatggagtgaagaccgaagctaacgtccagcgtggcggtgtggatgttcaccggttgaccggagtcgccgtatcggtgagcggaactgggctcgacggagcggtcgtggagacgtcgaccccacttgagaatgttcctgccggcgcgattttccgcgcagaaggagctgccgaagtatcggtacgcgccgagggccggcaaggattcggtgggggtagtccgcgaggtgtgcttgccgtgacggtattcgtcgagcggctggttccaatcggaaacgcgaatgatgtagtgcgctcatcgcctcagaggcgcccggcggcgggtgagtaaccgtgcgcggccagtatggatatacatcgccggcgttgaccgcggtgagatgcctctccgatgctcgatggacaagaagcatgttggagctcgttgggttgagtcgagcgcttccgacgaagcgttcagcttggtcgttgctggctgagggcgccgtgaggaatcgtgtgccgacgcggatgacatacctaaagtcgtatgtgccgacgttgatctcggtggctccggcaccgtacggagcgaatgcgcgatttgctgggctgctcgggcaagatctcagacagtggcaggtggcggctccgaagctggcgtcagctattggtgtaccgaatgttgttgtcaccgagccggtcccaggtgtgttcgagttgcagctgagaattgtcgatccgcttagttcgccgcttgaatggtcgtctgtgccagccgcccactcgtggtctctgagtttgggtatcgatgaaatgggcgtctaccagtcgctcccgttggcgaacgtatcgggcgttgtagtgggaggcgtaccagggtcggggaaaaccgcgtggctgacgagtgctctggggtcgttcggtgcgtcagcggcggtccagttcgctgtcatcgacgggaagggtggtcaggacttggaatgcctgcgtgctcgtagctgccgattcatgaatgacgatctggagctgcctgagattgcagcgattctgaatgacgcgaccggtctagtccgtgatcgaattagacagggcaacaacatattcggatcgtccaacttttgggatcgcggcccgacgccgcaggttccgctggtgttcgtggtgattgacgagtgccaagcgttcctggacccgcgccagttggtgacgaaggagaggaaagctatcggggccgagatccatgcctcggttaactacttggtgaggaaagggcgatcggcgggagtcgtatcgatcttgtcgacgcaaaagccgacggccgattcgttgcccacggacatcagagataacgcgtcgttgagagtgtgcttcggtgtccaatctacatatgcggcaacggcagtccttggagacgggtggcgaagtgacacggatgtgtcgccgctcgggatgtcgtcgggcgtcggagtctcatttatcggcggccactttcggcggttccgggctcccttcgttcgagagcgcgtaattgcgacccattcgtggcgttggtcatccctgaatcgtgacccatgggaactccttcgaccggaattggcagatggtcatgttcgcgattcctagggaaagcggtctattccgccgtatatctgtcggtccgacatcctcagcggcgcgcttgcggattggcggtcataactgttgcaacggcactcgggcacaagccgccggctggcggcgcgtgagcacagggatacgtgagaggggtcgatggtgacggtcgaggacttgggtcgccgtgctgggcgacagcctctactcctgaacatcgaggaactggcggatcgactgacggtaagcgtcggctgcattcggtcctggcggttgaagggggagggtccgccagcgatccgggtcgggacggcgcttcgttgggacgctgtcgaagtggatgcatggctggacgcacgacgggaatcacgattggaagcaggatgatcgagccacgtgtcggaccgcacggtacccgcgtgtatcgggctcgtgtctactaccgcggtcgctacgtcgcatctcggacgttttcccgcaaacgcgatgcacaggagtgggaacgtaagcaggtcgagacactgaagaccggcgcgtgggccgatcccaaggcaggtgaacgtccggtccgcgaatggtgtgagatgtggctgtcggctcaacccgtcagagcaccggcgacggagcggaagatccgcggcgttatcggaaagcagatcgccggcacattcggccggcgccctctggtctctgtccgcccgtccgaggtccaggcgtgggccgctgagatttctcgaaagcagtcggcggcgacggcccgccactcgctgggggtactgcgccgagtctttgaacatgcggtccgcgatggggccatccaccgcaacccggccgcaggcatccgcttgccgaaggtgcaaggcaacgatccgcgcccgctcactcacgacgaactgtggcgactggctgaccacatgaaccaattgcgtgaccgactcttgatcgtcgtagccggatactgcggtctacgctggggcgaacttgctgcgctgcgatgggccgatgtcgacctcgccaacaagactctgcgagtcgcccgggcctattccgaggaagcgccgcggggcgagatgtcaccagtcaaggaccaccaggcccgaacggtgccgattcctgcgatcgtgtcagaggaactcgccacattcaggacagatcagaaaccaaatgacctcgtgtttccatctgcgaacggtacgccgctccggaaccggaattttcgtcgtgacgtattcgacgacgccgcagaagatcttgggctcaacatcaccccacacaatttgcgggacactgcggcgtcgcttgcgatccaagcgggcgcgtccgtcgtcgcggtggctcgactgcttgggcacgaatctgccgcgaccacgctgaaccactacgcggccttcttcccgactgacctggacgatgtggcgtcacggctcaatgcggcagctcggctgacaatcgcagtgcagcgtgctcggcaggaccgcgaggccagaatcgaaggcgagctggggcaacagcctggctacatcgagcagctggaatacgatgccgcgcaccccgaaaacgcggtggaagtcgatggtgagcaggcgtccgcacgggacgaaacggagtatcttctgagctcgcctgagaatgcacgtcgactcctggaagccctgggccgagacaaagcaatccatccggcaccatcggataccacagaagcaccgaccacacaccgaccagagaggagtgacgagcagtagggcaagcgcccggaaaccctcgctgacctgcaaaaatggtgagtgcccccggcaggattcgaacctgcgacaccggctttaggagagccgtgctctatcccctgagctacgagggcggacggcccgagcttaccggggcggcgcgccgagaaccgaaatccgccgtcagcgcagttcggcgatgaccttggcgaagttgtcgatgtggttgtcctgcacggtgaaggacgagacgccgtacttgtcgcggtaggccgacaaggtgtcggcgatgtcgcgcggcgaaccgctgagcaccgacggcatcgacaggatctgctcgtcggtcagctcgggggagtagctgcgggtcagcttgaggtcgggctcggtctcaccgacgcgcggcatggccgtgatggccagattcaactcgagcgagtcgaaccgatcgccggccgcgttgcggacgaactcgacgcgctcggcgaacgggtcctcgacgtcgcgcaccttggcgccggtcagcccgatgatgtcggcattgcgggcggcgatggtcagcacccggtccccgttgccggcgatgatcagcggtgtcgacgggtggtgttccttgaggtacttcgtcatgtgttcgaggtagtcgacccgctcgcgggcgctgggatacgggatctcggcggcttcgaactcttcgcggacatagccggtgcccagcccgatctcgaggcggccgtcgctgagcagatcgagggcctgcatgtcccggctgagcagggccggcttgtagaacgcggaattgagcacgtacatgctcagccgcagcgtcgtggtgaccatggcgaccgcggtcagcgtcgggaacggtgccgcggcgcccaaatggtcaggtacacaaaggatgtcaaagccggcgtcttcggcgcgcttggccttgtcgagcagcgcctcccgcgacttgtagaaccgcatgctcattccaaagcgaaagtccttggccaccaacactctccgttcaatgatccgacattgaccaacaacgggcggcatccgccaacccctggatcagggcgccggtcaccggcgataagccgtcgtcgccgggcagcgggctgcgcgggctgagcccccggacccgcgccgagagctccagctggactccgccgtcacgcacccgattcaccgggttcgccgggtgcaggccgcgcaactcggcggggatgtcctcgaggtcggtgatcacccggtagccggccaaccggacgtgccgggccaaatgatcggccagcgcccggttgcggccgccggccaacaattgggtgctgcgaccgtcgcggccatacccgtgcagcgacaccgcaacgtcgacgtggtcgaggaactcggccagccgcggcgactcggccgggtcgaaccgggccgacggcaggtgatgcgggtaggcggcgggatggcgcaccacgtataccgacgcgccggcggccgcggcggcgcgttcggcgatcacgtcggtcatctcttccagcccgccgccgtgaatggccaaaaacccgaagcccgaacgcaattggctggactcagtcacgccggtaacacgcagcagtgccgaaagtgattgcggcccaagcccattcgagggcgacgtggctcgcggacttggccagccggcggggtcccagcggcgcaagaagtcgatccagcgttgcggcaacccgtgctgggtggcgccgtcgacgatcttgggcaggtagcccggccgcggcgggcccggtgtcacccggtggtcgatgtacacccaggccggcgccggcccgtcatcggtgtgcacggtgagccggtcgcgccggtagcgcaccggcaccccttcggcgctgtccagggtcgccaagtcgccgtcggagatccgccacaccacgccgtgcacctggttaccggccagcggttcgacggtggccacgccgcgctgattgatcagccaatcgtgatcggccagcaccgcgggccgcggatcggccgcgtcgggacagcgctgcgccatctgccgtgcgcacaggttcgacccgtatgcgaagtagaggtgccggcgggccggcattcagccggtcaccgtcagccagatgagcaccatgttcagcagactaatcaagatgccgacgccccagccaaggatcgtcgtgatgcggtggttggcgtcggaccccatcagctcgcggtcgctggtcagcttgatcaacggcagcaccgcgaacggtatcccgaacgacagcaccacctgggacagcaccagggcgcgggtggtgtcgtatccgaccgccaggatcagcagcgcggggcacagcgtgatcaaccggcgcaccaccatcggaatcgagcggtgcagcagcccctgcatgatcatggcgccggcgtaggcacccaccgacgacgatgccagcccggaggcgagcaaccccacggcgaacatcaccgcgatggtcgcgcccagcgtgttgtggatcgcggcgtacgcgccctcgatcgaggcgctcacgtcgcggtgctgcaggttggtggcggcgatcagcagcatcgcggcgttcacggtgccggccaccgccatcgccagtaccacgtcccagcgggtgacgcgcagcagcaggcggcggtgcggcccctcgtcggggtgcccgtgccggtccaggaccagccccgaatgcatgtacaccgcatgcggcatgacggtggcgcccaggatggcggcggccagcagcacgctctcggtgccgcggaacctcgggagcagcccggacagcaccgcctccgggggcgcggtcttgacgaagaaactggccgcgaacccgatcgcgatgaccagcagcaggccggtgatgacccgttcgaagaggatctggccgcgccggtcctggatgcccaacagcagcagcgccaccacgccggtgatcagcccaccggccagcagcggcaacccgaacaggatgtgcaaggcgatggccccgccgaccacctcggccgcgtcggtggcgatggccaccagctcggcctgaacccaatagaccagccgcgccggacggctcatccgcttgccgatggtcgcgggcagggagcgcccggtcaccagcccgagcttggccgacaggtactgcaccaggccggccaggacgttggcggccacgatcacccaaagcagcaggtagccgtattgcgagccggcgctgacgttggccgcgacatttcccgggtcgacgtaggcgatggcggcgacgaacgcgggcccgagcaggtaccagttgcccttgagcgagccctgggtgcgctgcgccaacgtcgacctcgattcccacaggcgaataagaaagtgagggtagtcgaacattgccgccgtgccgtcggcggccacggcgtttccgtcgtcgcggcttactccgggcggtagaggccgcgcccggtgatcagcggcaggtccagcgtcgtgacgatgcccggcggggccgccaccaccgcggggatcgcgttgaccacccgcatcgcggtggccaccaagccggcgtggttgtgatcgcccttgcggctgctcaggcagatgtccatggcatacgacggttcgccggtgacctcgatgcggtaggagccgccgtgctgcgcgggctgcggccagtcggggcacaggtcctcgcgcagccgggtgacgtgttcgagaacgacgacgggacggccgtcgaccatcccgaacacctcgaagcgcagcgccgcggcggtgcccttggcgatgtgacctgacgcgatgtcgaagtcttcgggtgcgggcacccgcacgtgctgctgggtgacctcgtcgagcgaaacacccagtcccgccgccaattgccgcaccaccgatccccaggcggggctgagcacgccgggctgcagcagcatcggggtgtcgtccagcggcttaccgaatcccatcacgtcgaacatgaccgcggcgctgtcgtaggtcgcgtagtcgacgatctccatgcaccggatctgctggatgctctggcaggtgccggcgagcgccagcggcagcaggtcgttggcgaagccgggatcgataccgttgacatacaggctcgaattaccttgctgcgcagcctcttccagcggtttgatcagctcgtcggggatgacctgccacggatactgcaagaagaccggaccgctgccgacgatgttgatgccggcggccaggacgcgccggtagtcgtcgagcgcctcgggcaaccgattgtcggccagcgcgttgtacaccgcgcagcgcggtccggtggccagcaccgcgtccaggtcggtgctggcgagcacccccgtcggctgcgccagcccggcaagttctgccgcgtctttgccggccttggcgtccgaggacacccagacgccggtcagttcgaattgcggatccgtgatcagcgcccgcagcgcatggataccgacgttgccggtgccgagctggacgacgggtatgggcatgacatgctcctcagcggtcgggggtcacaggtccgggacggggatgtcgaggttggggtaggtcaacccgccgtccacctccagcgtcttgccggtcaaaaactccccggccggggacgccaaatacactgcggcagcggcgatgtcgacggggtcgccgagacggcgcagcggggtggccttctccatcggcgcccgcagctcgtcgttggaggccaccacgtcgagcgcggaggtgaggatcgagcccggcgcgatcgcgttgacccgaatccgcgggcacaggtccagggcggtcagccgggtgtagtgcgacagcgcggccttggccgtgccgtaggccgcgaaaccccgcccggccagccggcccatggtcgaggtgatcttgatgatgttcccgccgccggagtgctccagcatcagcggcacggccgccacggtgagcgcgtgggcggtggcgacgttgaaggtgaaggcgtccttgagatccttcgtcgaggtagtcagcagcgtgttgggcatggtgccgccgacgttgttgacgacgatgtctagtttcccgaaggcctcgacggcccgggcggccagctccgcggtggactcgggatgcgccaggtcggccgccaccacatgcgcccgacgaccggcggcgcggacttgctcggcgacggcttctagttgcgattcggtgcgcgaggcgatcagaacgtccgcgccggcctcggcgaaggcaaccgcgatggccgccccgaggccgcggcccgcacccgtgatgacggcgactttgtcgtcgaggcggaacctgtcaaggatcatggcggtctcttttctttcggtgtcagccgacacggtagcaagccacgccgtcccggatccgggcatttctggaacaggttctacttttcctccggcgccgctcacgcgccgcccggcgctaccgccggtcgcgcgcggcgcgcaccggcgacggtgccgcacccgcggcctcgggaaacggcttgagggtcaacctgtttggtgccagggcgccgcggtgcggctccgctcggcgagccgaccgaccgcccgcggcgggccgatccgtaacaccctcgcttcgctttgctgtcatgccccggctattcggcgtcgccgccggcttctgccgacgtcgacgcggcgtgttgcgccgttcagcgaaggccgccgaacagtttgctcatagttaaccttgttactgttagcttcgtggctgcgagacgggctggtcggcacgcggttgccggtggaccggcggcgaacatgtttcatccctaccgtgaggaagcgaattgaaactcaaccgatttggtgccgtgctgagcgtcttgagcgccggcgcgctggtgttgtcgggatgcggaagcgataacaacggggccggcgccggtgccggcggctcgtcgtcgagcaaggtgagctgcggtggcaagaaggccctcaaggccagcggctcgaccgcccaggccaacgcgatgacccgcttcgtcaacgccttcgaacaggcctgccccggccagacattgaattacacggccaacggttccggtgccgggatcagcgaattcaacggcaagcaaaccgatttcggtggttccgactcgccgctggcgcccagtgaatacgccgcggcgcagcagcgttgcggctcgccggcctggaatctgccggtggttttcggcccgatcgccatcacctacaacgtcgccgggctgaactcgctgaacctggacggcgcgaccgccgccaaaatcttcaacggcgccatcacgacgtggaatgacccggggatccaggcgctcaaccccggcgttgccctgcccgccgagccgattcacgtcgtcttccgcaacgacgaatccggcaccaccgacaatttccagaaatatctcgatgccgccgccgacggcgcctggggcaagggcgccggcaagaccttcaagggcggcgtcggcgagggagccaagggcaacgacggcacctcggcggcgatcaaggccaccgaagggtccatcacctacaacgagtggtcgttcgctcaggcgcagaagctgaacatggccaagatcatcacgtcggccggtccggacgcggtggcgatcagcgccgactcggtgggcaagacgatcgcgggagccaagatctccggccagggcaacgatctggtgctcgacaccctgtcgttctacaagcccacccaggccgggtcgtacccgatcgtgctggccacctacgagatcgtctgctcgaagtaccccgacccccaggtcggcacggcggtcaaggcgttcctgcagagcaccgtcggcgccggccagaacggtctggccgacaacggctacatcccgatccccgacgccttcaagtcgagactgtctgctgccatcaacgcaatcacctaacctgaggtggtcgtgacacgaggaacagcaaccgcgcagctgcccgcaccgacgacgctgaacgcgcgggtaccgcggcggggcgaccggctgttcaaggcgatcgccgccgccgccgggttcacgatcgtggtcgcgatcgcgttgatcgcggtgttcctgttgctgcgtgccgttccgtcgttgcgcgtcaaccacgcgaacttcttcaccagcgcccagtccagcaccagcgacccgcatcggctcgcgttcggcatccgcgacctgctcatggtcacggtgctcagttcgctcagcgcgctggtgctggccgtccccatcgcggtcggtatcgcggtgtttctcacccagtacgcgcccagacgactggcccgcccgttcggcgcgatcgtcgacctgctcgccgcggtgccgtcgatcatcttcgggctgtgggggattttcgtgctggccccccagctcgagccggtggcggcgttcctcaaccgccacctgggatggttcttcctgttcaaaaccggcaacgtgtcgttggccggcggcggcaccatcttcaccgccgccgtcgtgctctcggtgatgatcttgccgatcgtcacgtcggtgtcccgcgaggtctttcggcagaccccgcacatccagatggaagccgcacaggcattgggcgccaccaagtgggaggtggtgcggatgacggtgctgccgttcggccgcagcggcgtgatcgcggcctcgatgctcgggctgggccgggccctgggcgagacggtggccgtgctgatcatcttgcggtcggcggcccgcccggggcactggtcactgttcgacggcggctacacgttcgcctccaagatcgcctcggcggccgcggagttcagctcgccgctgcccaccggcgcctacatctcggcgggtttcgcgctgttcgttttgacgttcatcgtcaacgcgctcgcgcgggcgatcgccggcggcaaggtcaacggatgacccgggccgtcgacgcgctcgaccggccggtcaagaccgaggtgttccggccgctgagtgtgcggcgccggatcaccaacaacgccgcgacgatcttcttcctcggttcgttcgtcgtcgcgctggtgccgttgatctgggtgctgtcggtggtgctggaacggggctggtacgccgtcacccgctcggggtggtggacccactcgctgcacggcgtgctgcccgagcagttcgccggcggcgtctaccacgcgctgtacgggaccgtggtgcaagccggggtggccgccgccatggccgtgccgctgggcctgatgaccgcggtcttcctggtcgaatacgggtccggccggctggtgcggctgacgaccttcatggtcgacgtgctcgccggggtgccctcgatcgtggcggcgctgttcatcttcagcctctggatcgccacgctgggcttccagcagagctcgttcgccgtctcgctggccctggtgttgttgatgctgccggtggtggtgcgctcggccgaggagatgctgcggttggtgcccgacgacctgcgcgaagccagctatgcgctgggcgtgccgcaatggaagaccatcgtgcacatcgtgttccccatcgcgatgcccggcatcgtgtcgggcatcctgttgtccatcgcgcgggtgatcggggaaaccgcgccggtgctggtgctggtcggctacagccgatcgatcaacctggacatcttccacggcaacatggcctcgctgccgttgctgatttacaccgaactgaccaaccccgaacacgccggcttcctgcggatctggggtgcggcgctgaccctgatcatcattgtcgcggtgatcaacgtcatcgccgcggccacccgattcctggccggtcgccggcgctgacggcgtcaggacctcgaagcagccttcttggcgggcgccttcttggccgcgcccttcttcgcgggtgccttcttggcggcggtcttcttggcgggcgacttcttcgccggcgctttgccgtcccccgagcgggccttcacgctggcctccagctttgccagcagatcggagacgtcctcggtctcgtccagttgcttgggttgctcctcggtggtaaacgcttctccgccttcgagtttggcctgaaccagctcgtgcagctgttcctggtagtcgtcgtggtagcggtcggggttgaagtcttcggccatcgactccaccacctggccggccatcttcagttcggccggcttgatctcgaccttcttgtccaggatggggaagtccgggtcgcggatctcgtcgggccacaacaaggtgtggatcaccatcacgtcgcgcttgccgaagtccttgacccgcaaggccgccagccgcgtcttgttgcgcaacgtgaaatgcacgatcgccatccggtccgtctccgcgagggttttggcaagcagcacatacgatttcgaggacttcgaatccggctccagaaaatagctgcggtcgaacagcatcgggtccacctcgttggccgggacgaactcgagcacctcgatctcgcggctgcgttcttcgggcaaggtggcgatgtcgtcgtcagtgatgattaccatctggccgtcgtcggattcgtaggcccgggcgatgtcgcggtactcgacgacctccccgtccagctcgcacacccgctggtaccggatacggccgttgtccttggcgtgtacctggtggaacttgatgtcgtggtcttcggtcgcgctgtacaccttgaccgggacgttcaccagcccgaacgcgatggaacccttccaaatggagcgcatgtaagtcagtatgcccacaccacccccggataagcgtctaacgacgcaaagcggcctgcacagcggcccgatccggcaggtcggcccccgcgcgcgcgatggtcagcgccgacgacaggctggccgcgtcgagcgccgaggtcagggtgtcgatcccgatgtcccgcagcgcgccgcgccggtcgccgcccagcaaccccgcttcccacagcgcgtcgagcagcccggccatgaaggagtcgccggcgccgaccgtgtcgaccacccgcaccgcgcgggtcggcacccgggcggttccggccgcgcagtagcccaccgcgccccggtcggccatcgtcaccgccacgatggccggacccagccccagccaggtctgcgcgagctgctcgggcgagcggtcgggatcgatccagtgcagatcctccgcgctgaccttcacgatgtcgctgcgctcgacgagatgctcgatgcgcgacaccgccagttcccggtcggcgatcagcgacggccgcacgttcgggtcgaacgtgacggtggccgacacgcggtaggtgtcgatcaacgccgcgaccgccagacagcccggatcccgcaccgcggcaatggatccggtgtggacgaacagcgggggcgccaccggcggtgtcccggaaagccgccagtccagatcgaactcgtagtcggccgagccgtcggccgcgatggtcgaccgcgccgtcgccgtgcgctcggcggccctgctttccgaaacaagctgcaccccagcgtctttcaggtaggcggcgatgcgccggccatggtcgtcgtcggcgaggtaggtcaggaagtcgacgtcgcggcccagccggcccagtccgaccgcgacgttgagcgggctgccgccgacatactcggcatcctcgacgatgtcgatcagcgactcgccgatcaccagcccgcgggtcatcgcaccaactcttccagcgtcgcgcgagctcccttgcggtgcaacgattccagggcccagctgtaggcctgcacgaaccggggctggtgcgccaggtccccgaacacccccgcgatctcgatgaacgccgtgggattctcgtactgcgagcgggcgatcgggatcagcgagtccgccagctggtccaccacctcgaacggcttaccccactcgtcggtgccctcggcgtagcgggcccagctggcgacggccgcggccgcgatccgcaccgagccgtcgttggccaggttgtcgttgatcaccggcagcagccatttcgggatgcgatccgaggagaaggcgcacagccgcgcgatggtgtcgcgcacgccggggttggtgaaccgctcgatcagccggtgaccgtagtcgtacaggtcgatcccgggcaccggcggcagcgtcgggatggcttcggattcgaaataggcccacaggtattcggcgaacaacgggtcgcgcgcggcttcgtggacgaactcgaacccgcacagatgcgcgaagtaggccaggcactgatggcccgcgttgagcatccgcagcttcatcagctcgtagggcgcgacgtcgtcgaccagcagcacgccggcccgctccagcggcggcctgccgtcggcgaacttgtcttcgagcacccaggcggtgaacggctcggccaccaccggccagcggtcgttgacgccgaagtcccgccgcacctcggcggccatctgcaaggtggtggacggcgtgatccggtcgaccatcgaactcgggaagcacacgtgttcgtcgacccactcggcgagttcggggctgcgggcttccgcgttcgccagcacggcgcgccgcgcgatctcgccgttgttctcgatgttgtcgcacgacgcgatggtcggtgcggcgatcccgcggcgccggcgccggtccagggcctcgacgatgaacgcgaacgccggcccctccgggtcgcggtagccgccctcggtgatggtcagcgagatgatccgggtggtcggcgccgcaaggacttccagcgccgactcgggatcgtcgggcgcgtagcggtagtcgatgatcgagccgatcacgtgggcgtcgcggctgccgtcgggcttctccaggatcagcgtgtagagcccgtcctggtcgttgagcacgtcgcgcatcgtccagtccgcgggcatcacgcccaccccgcagatgccccactcccgggccaggccggcctgcagcaaccggtcgatgtacatggcctgatgcgcgcggtggaaatgtccggcaccgatgtgcgcgatgccgacggtcacgctgccgcggtcgtagttgggcgcctcgatgggcagcgtgggcagcgtcgcgttgttcaggtttatcccgtcagcctccattggccaactcctcccgggccgcagcgcggatggttaccgggctcgcagcacctctcgacggtacgacggccgcgggccaaaagctaaatgcccgccggcggggaccagttgaggaccagtcgatgtcctaggcgagtgaagatcctgccgccggcacggccgacgagagcaggacatcggcaagggcgcgccacgagtcggtgatcgcgaccgccccggcgtcgatcaattccgcacggcggcaatcccgttcgtcgggcagcacgaacatcaggttgccgacggtggcgtagccggcggcgaccgcggaactcacgccggccaccgagtcttcgatggccagcccttgttccggcgcgacgcccagcacctgcccggcgtgcagatacaccgcggggtcgggcttgctggtcggcaccggaagggaatcctccgcgctgaaccgcaccgacgccgggatcagcggatccaggtcggtggccgaaaagcagccggcgaggcgcttgagggcgctggagctgaccgccgccagcgcgtaccgcgacgccagatcctgcagtggcgcaagcacttcggggtccggtcgcagggtggcggccagatgcgcggtgacctgctcgcgctcctgcagtacccactgctcgagttcctcggcgcacaacgcccgatccgccgccgtgtcgtcggccgacgcgacgacggcctcgggccggccctgcgccagggtctggtcgatcggcacaccggacgccaccgccaggtccagggcggtgctgcggaagttcttgccgaccgcctgcttgcgcagctgctccgcggtgaacggggcggccacgccgaaccgggccaggaaacggttgatcacctcgacggaggcggcgaaagccggtctctcggaagggaacaggttgtcgtcggcgtcacagagcagggtggtgatcggtgccgggtcgaattcccgcaccatcgtcagtccctcgggtttcatcgcgccaccaactcccgggaatcgtcctgcaacgattggcgcagcgtggcaatcacgccgtgctcgtcgatgctggcgaccatctcgccgaggcgctcggagaatccgggcaccaaccggagatcggccaggatctcgtgccgcagcaacggatcggggttgttgccggccatgttcgccagcttggtcagcaggtccgcctccgggtcgtcgatgcggatcttgcgaccgttcaggtcgtagccgcgcaggtagcgcgcccagccggccagcgccaacatcagcagcgtgtgcggtcggtcctgcgcgatcgcctcgtgcagcgacggcagcaggaacgaggcgatcttcgtcgatccccgccgcgccaaccgggacaactggtcgctcatgcggggattgcccagccgggtgagcaacgtgtcgcggtagtcgggcgtgttcatcccgggcaccgggggcagcagcggctgcacctcgtcgcgcatgagccgctcgacgtagtcgaagatgaccggatccttcatcgcttcgtcggtgcgccggtagccggccagcgtggccagacaggccagcgcgatatgggttccgttgagcagccgggtcttgatcagcttgtggtcgctgacgtccgtcacgaactggacgccgacctcgtccagcggcgggcggccgtcgctgaaggcgtcctcgatgatccactgactgtgcggttcggtgagcaccggccagttgtcggcgacaccgaaggtgcgctcgacgaattcgcgctccgagtccgacgtctgcggcgtgatgcggtcgaccatggtcgacgggaacgcgacatgccggtcgatccagcgggccagccccgggttcttcagcgcggcgaacgacaccagggcggtgcgcgccgcctgggtgttgtcgggaatgttgtcgcagcacagcaccgtgaacggcgcgatgcccgcgcggcggcgctgctcgagcgcctcggtcaggtatccccacgccgtgccgtagcagcccgacgcgacaaggtcggcgcgcacatcggggtggtcggcgtcgaactcgcgggtgaccggatccaggaagtacccgttgggggtgatggtcaggctgacgatgcgggtgcgcggatcggtcagcgccgcgcggaccgctgcgccgtcattcggtgcgtagtggacagagccgatcgagccgacgacgcgcgcggtttggtgatcgtggccgcgctgcacaacggtgtagagcccgtcctgggcggacagcagatccttcacgtcgtgcgagcgaaggctgatcgcgctgacaccccactgatcggaaatgcccgagcaggcaaggtcatcgaagtagacggcttggtgggcacggtgaaaattgcccgctccgatgtgcaccacaccacgttgcagtgccgacctgtcataggtcggcacgtcgattcgttgcgaatgcaggggcagggtggcgttactcagcggaagagcccgcatgcggcgccgagcgacgactcgcgaaaagcagtcgatataactcattgcgggccaaatgtaccgccgatcaagggggtctgaccaagttcagtattcggggcccgcgccgccgcgcgcggcatcgccgccgtcaacagccgattcacgggcacagtgaaattcgccacaccagggtgttggtcaccggtaccggcgtcgccgccccgcaccttgcggctcgcgtgtcggccgccgattgcaccctggcgtcggcggcaccggcgcgtaggtttagcagcatgaacgcgccgcgcgcttggcccgctgagccgacagcgacgccgcgggtgaaactgaccaacgccgacaaggtgctctatcccgcgacgggaaccaccaaagccgacgtcttcgactactacacgcggatcgccgacgtgatgatcccgcacatcgccgggcgtccggtcacccggaagcgctggcccaacggcgtcgatcaggaatcgttcttcgaaaagcagctggcctcctcggcaccggactggctgccgcgcgccagcgtgacccaccgatccggcacgacgacctatccgatcatcgacagcgccaccggcctggcctggatcgcccagcaggcggcgctggaggtgcacgtgccgcagtggcggttcgtcgcggagtggacccgaagccgggccgaagaactcaaacccggcccggcgactcgactggtgttcgacctcgacccgggcgaaggcgtgacgatggcccagctcgccgaggtggcgcgcgccgtccgcgacctgatcgatgggatcgggctgcagacgtttccgctcaccagcggcagcaagggactgcacctgtacacgccgctgacggagccggtgagcagcaaaggcgccaccgtgctggccaaacgcgttgcgcagcaactggaaaagaccatgccgaagctggtcacctcgaccatgaccaagagcctgcgggcgggaaagatctttgtggactggagccagaacaacggctccaagacgaccatcgcgccctattcgctgcgcgggcgcgaccaccccaccgtcgccgcgccgcgcacctgggacgaactcgacgacccggcgctgcgtcacctgcgctacgacgaagtgctgacccgggtcgcccgcgacggtgacctgctcgccgagctggacgacaaccagacaccggtgccggaccgcctgaccaaataccgcagcatgcgcgacgcctccaaaacacccgagccggttccggacgcgaaacctgctgcgggacaaggtaataccttcgtcatccaagagcaccacgcccggcggctgcactacgacttccggctggagcgcgacggggtgctggtgtcctgggcggtgccgaagaacctgcccgacacccccgcggtgaatcacctggccgtgcacaccgaggatcacccgctggaatacggcgggttcgagggcgtcatccccaaaggcgaatacggggcgggcagggtggtcatctgggactccggaacctatgacgccgagaagttccaggacgacgaggtgatcgtcaacctgcacggccgcaagatctccgggcgctacgcgctgatccagacccagggcgaccaatggctggcgcaccggatgaaggaccagaacgtcttcgagttcgacacgatcgccccgatgctcgccacccacggttcggtgtcggcgctcaaggcgagccagtgggcgttcgagggcaaatgggacggctaccggctactggtcgaggccgaccacggcaccctgcgggtgcggtcccggcgcggtcgcgaagtcaccggcgagtaccgcgaattacgctcgctggcaaaggctctcgaggagcaccacgcggtgctcgacggcgaggccgtggtgctggacaagcgcggcgtgcccaacttccacgagatgcaaaaccgcggcaagagcgcgcgggtcgaattctgggcgttcgacctgctctacctcgacggccgctcgctgctgcgggcccgctaccgcgaccggcgaaaactgttggaaatgctggcctccggcggtgctctcaccgttcccgagctgctgcccggcgacggcgaccaagcgctgcggcagtccgccgagcgcggttgggagggcgtgatcgccaagcggcgcgactccacctatcagcccggccggcgctcgtcctcctggatcaaggacaagcattggaacacccaggaagtcgtgatcggcggctggaaggccggggaaggcggacgcagcagcggcatcggttccctgctgatgggcattccgggcccgggcggcctgcacttcgccggccgcgtcggcaccgggttcaccgaacgcgacctagccaacttgaagaagacgctggccccgctgcgcaccgaccaatcgcccttcgatgcgccgcttccccgcagcgaggccaagggcgtcacgttcgtcgagccggtgctggtgggcgaggtgcgctacagcgagtggacaccggatgaccggctgcgccaatcgagttggcgcgggctgcggccggacaaggaagcaagcgaggtggtacgcgagtgaaatgggttacctaccaaggcgatgacggcgaacgcgtcggagtgctgcgcgacgacaccatctacgcgatgggttcgggagtcacgctgctggacctgattgcgcgcggcgccgagggattgcggcacgcgggggaggaggcgcagcgttcgccggcggcgacggtgccggcggcccgggcgcggttgctggcgccgatcccgcgcccgccgtcgatcagggactcgctgtgcttcctcgaccacatgcgcaactgccaggccgcgctgggcgccgggcgggtcctcgccgacacctggtatcgcgtaccggcgttctacttcgcctgtccggcaacggttttgggcccgtacgacgacgcgcccaccgcacccggaagtgcctggcaggacttcgaattggagatcgccgcggtgatcgggaccggcggaaaggatctctccgtcgagcaggccgaacaggccatcatcggctacaccatcttcaacgactggtccgcgcgcgatctgcagcagctggacagtcaactcggtatcggccaggccaagggcaaggacagcggcgtcacgctagggccttacctggtgacacccgacgagctcgaaccctaccgccggaacggcaaactggacctgcgggtcaccgcctcggtcaacgacaccgtcatcggttccgggtcgaccgcccaaatggactggaccttcggcgaagtcatctcctatgcgtcgcgcggcgtcaccctggtacccggtgacgtcatcgggtccgggacggtgcccacctgcacactggtcgagcacctggatcccgcggcgctggaatcatttccgggctggctgcacgacggcgacgtcgtcacgctgcgggtcgaagggctgggcgagacccggcaaaccgtgcgcgccagcggcgcgccgcacccgctggccgcccggcccaacccggacgccccgccggccgcaccgcgggtcaaccgggccgcggcgcgggtgccctacacccgcgggctgcaccaggtcggcgaccgggtgtgggcatggacgctgcccgacgggggctacggctggagcaatgccggcctgatcgccggcgacggcgcctcgctgctggtggacaccctgttcgacctggcgttgacccgcgaaatgctcacggccatgcggccgatcaccgcgtcggcgccgatcaccaaagcggtgatcacgcactccaacggcgaccacacgcacggcaaccagctgctcgaccccgcggtgcgcatcatcgccgcgcacggcaccgccgaggagatcgcgcacgggatggcgccggagatgctggccatggcccaaaccgccgacctgggcccggtggccacccgctacacgcgagaacgcttcgggcacttcgacttcagcaacatcacgctgcgcaacgccgacgagacgttcgaccgcagcctggccgtggaggtcggtggccggcgggtcgacgtgctgaatctggggcccgcgcacaccgccgccgactcggtggtgcacgtccccgacgcgggggtgctgttcggcggtgacctgttgttcatcggctgcacccccatcgtgtgggccggcccgatcgccaactgggtcgcggcctgcgatgcgatgatcgcgctggacgcgccgaccgtggtgcccggccacgggccggtcaccgatccggacggaatccgcgcggtgcgtgggtatctcgtgcacatcgccgaacaggccgaggccgcctaccgcaagggcctgtcgtggtccgaggccgcggacaccatcgacctcggcgagtacgcgacctggctggacgccgagcgggtcgtcgtcaacgtctaccagcgataccgcgaactcgacccgcacaccccgcaactggaagcgatggccctgctggtgatgcaggccgaatggctggccagacggtcctgaccgggtgctcgctgcggtcaggacttgatcgcccgcacgaagctgagcgtggcggccggcccctgctcggcctcggtgagttccggcaggcccgccgcggcgaacaggtcggccagcccgaacgtggtcgttgcccagccgtcggcgcccaggtgcgcggcgacgtcggtgtgcttgcccgggtaggtcagggcggcgatgtccatgtccagcccacgccggcgccagccctcggtcgtgcgccgcgcctgctccgtcgacgcctgcgaggcgtcgttgagcgacccgtagtccgcggcgaagcggctgccctcggccgacagcggggtgatcgagtccagcagccgaacctcggcctccggcggcagaaacccgatgagcaccccctcggccagccacgcggtgggctgcgcgggatcgaagccggcgtcctgcagcgccgccggccaatcctggcgcaggtcgatgccgatggtgcgcagctcggccgtcggggccgcaccgatccgcgacagcgtcgcggtcttgaacgcgatcacctcgggctggtcgatctcatacaccgtcgtccccgccggccaggaaagccggtacggccgggcgtccagccccgacgccacgatgaccacctggcgcacgcccgccttgccggccgcggcgaagtagtcgtcgtagaaccggccgcgggccgcgaatgtgtcgaccatgcgggcgaatccgacgtcgcgctcgagatcgtcgggatcgagctcgccgctcgccaacttggtgaacacgtccaatccgacggcgcggaccaacggctcggcgtactcgtcggtgaggaccggccgcggacgccgggtcgcggccgcgcgcgcggcggcgaccatggtcgcggtggcgccgacgctgctggccaggttccaggtatcaccctcgctgcgtgtcatgcgtgcatgctatgctgggtcgttgaactgccgcggtgtcgcttacggttcacctatgcccgcagtggaattcgcgaccctcgacgacgacatcgcctgcatcaccctgaaccgccccgaacgcctcaacgccatcgacggctcgctgatcgacggtgtccacgaggccctggacatgctggacaacggtgaccaccgggtggcggtcctcaccggcgcgggccggggattctgtgccggtgccgatctgagcggtaccggccggccgtggacgcggaacaagccgaccaccccggcgttcaaggtcaactacgacgcccaggtccggctggccagcctgtacacccggatctacgagctcgatatcccggtgatcgccgcggtcaacggcgtcgccgtcggcggcgggctggcgttcgcgttggtcagcgatatccgggtgggctcggagcaggcccggttcggttcggtgttcatcaaggccggcttctcgtcgatggacatgggcaccagctacctgctgcctaaaatcgtcggcgccggggtggcccgcgagctgatgctcaccggccgcatcatcgacgcggccgaggcctatcgcatcaggctggtgcacgaggttgtcgcgcccgatcagctgatgcccgccgcgctgcggttggcccgctcgatcgccgagaacaacgcttatggcgtgtggcagaccaagatcgggctcaacgcggcgctggacgcgcccagcctgcgccacgccatcgagctggagaaccgcacccagatcctgtccggtttcaccaacaacccggccgaggccgccctggcacaccgggagaagcgagcgccgaggtgggaccccctgtaaagcgctgtgacgcttggggtttggcgacgtccggtcagaccttcgcgatcacgttctcggcgaacatctccagattgcggatcttggtgtccagcggctcggtgtctttgcccttgatgtagggaatgcggaagcccacgatcacgtcggtgacgcccttgtcctcgagccgtttgatgccgtccggggtgtaggcgtcggcggagatgacgtggatctcgaacggcccggtcttgccggcttcctcgcggaaccgcttgagcttggcaaggaggtggtcgagctcctccgggtccccgccgccgtgcatccagccgtccagccgtgcggcacgccgcagcgcagcgtcggcgtgcccgccgaccaggatcgggatcggcttggtgggcgccggcgtcatcttggtcttgggaatgtcgtagaactcgccgtggaattcgaagtactcaccggtggtgagaccctggatgatctcgatgcattcgtccatccgcttgccgcgcctggcgaaggggacgcccagcaactcgtagtcctcgggccacgggctggtgccgacgccgaaacccacccggttgtcggtcatggcggccagcgacccaatctgcttggccaccaacgccggtggccggatcggcagcttcagcacgaagaagttgaaccgcagcttcgaggtcaccgcgcccaatgccgatgtgagaacgaaggtttcgatgaattccttgccgtccaagaactcccggctgccgtccggagtgtaggggtacttcgagtcggattcgaaggggtaggcgatgctgtcggcgatcgtcatggcgtggtacccggccgcctcggcggccttggccagcgggatgtagtacctaaagtccgtcatcgcctctgcgtaggtaaaccgcacgtcatctgccttcctgaaggggtcgtcacacgacattagaacgtgttctagtttcagcacaaccggcagatcggcgcgccggcttcccgggaggccgccggctagagctggttctcggggccgatgatcgcccacaccgtcttgcccgacgccgtgggcgtgctgccccacgcgcgcgacaaggcgtcgacgatcgccagcccggacacgtcgatgcccttgaccggcgacggcagccgcacggcgggcgtgttgctggcgtcggagacggcgatggtggccgtggtgccctgcgcctcgacccgcatcaccggcacgctcgcggtgtgttccagcacgttctccacgaatacgttgacgaccaccagggcgaccggaatgagcttggactgtgaccacgtggtgagccactcgcgcaccaggcgccgtgactcgcgcaggctggtcagatcggcgggcagctgggcatcggcgcgccgcacgatgcgacggctgttggggcccagtgccttcaaggccgccttctggctcgagtacaccggcatgaagtgggtgatgccgctgcgggcgatcgcctcgcgggcggccttcttggcgcacaccaacacgagcggaacatgcggcgtgtttcccagctgccagtaggtggccatgaaggtcgaccaggtggattcggcgttcaccttcagcgcggagacgtcgatgacgacggcgcgggtctggtccagcgtggccttgatgatccggtcgcgaaggagggtggagctggcgggatcgagcacgccgtcgacggtcagcacggtggccgcatcatccgtccgcgtcgacacggccaatgagccggccgactcagcaacccggctcatcccggctcggtccggacgtccggtgtcatttcccgctcctcgtgttctgccgggtcgactgcttgagtatccgccttcaggagcaaaagtctagttcgcgatcggctggcctcaaggcggcgcggaaccgcaggttgcgatcggcgtccccgcgggcccgcgtcgccggcccgcaacgcaaggatcatgcgccccctccccgcccgcgcggcgtcgatgcgcacttcccccaaacgcgccgtgatcaggtgtccagcacgagcttgcctggggttaccacgcgggtccggccgtcaaactccccgcgagtccgcaaggcgggagcgcggccagcgcaacggcgacggccgctcagcggtggccagggtagggcggggcgccgatgccggcgaccgtgtgcgtgccccacggtgtgcgttcgacgatgcgggccggcgcgctgcgctggcccacggtcagggtggcggcgcgggcctggccgagcaggtcgccgggcagcggctgcgacggcgacccgaataccgttccctgccagtggtatcggccgtcgatggggtccaggtggcccgtcagccgcacccgcaccggatgccggtcaccggcgatctcgagcgtggcggcgccgtcgtaggtgtcatcgccggcgggcgtgctggccgaaaggtcgaaggcggacgccaccgggggcggctcgaccgggcgtagctgggcgcgttcgttgaacacctgctggctgctggcgcgcacctcgatgcggcggctgccggtgcgctgcatgagcttcaggcactcgacgatgtagcgcgcctgcgggccgggatccggtccgctggcgaagaagtagttgggaaagccgcggaccgcgacgccgcagaacggttccgtgccgtcgggccaggcccgccggaggggcaggccgccggcgccggtgatcgtgtcgtcggcgacgtgcgcggggatggcgaagccggtgccgtagatgatggcgtcgacgtggtggtgggcgccgtcggcgtctgcacgcccgagcgggtcaccgcccggatcggcgacggcacgatcaccggcccgggccgtcgcggtgtccgaagcagccggcgtcgggcgcgggttggccagcgcggtatctcgggcaccacccggcggggagcatgagcgaacaccaggaccgacgccgcggtgtgcgccagccggccgaggtggtgcgcggcggcggcgtcggtgccgatcaccgcgatgcgtttgcgggatgggtcgaagccgggatcccacgccgcggcgtgaaacgacgcgccgccgaactcgtcgcgcccggcgatgtcgggcagccagggcacctgcgccggccggtatgcggcgacgacgacatcggcgccccagagttggccgccggtcgtggtcagccgccaggcgtcggcgtcgtcgtcgaaccgggaccggcggacttcatggtcgggccgatccagggtgaccaggtcggtgaatccggcggcgcgcagggcggatcggacgcaccgcccggcggctcccgcgcccacgaccgcgatgtggcagcggcccccggcgccttcgcgcggcgccgtcacagaaacctgctgcgcttccagccgcgacgcgcgagcgggcccatcaggcccacctcggtcaggaacgccgccaggggagcgaaccccgcgatctggatctcgcggcgatgggcgctggtgcgcgcggtctttcgggcccgcttggggtccaggccggcacgcgcataggggaccgggttgctgaacagatagttgaagaagtagccgcccagcccgttgatgttggccatgaaccagcggttgagccggggcatctcggcgacccgtttgcgcgccccgtcgcgcgcgaactggatgtggcgggcctcctcggtgacgtgaatccgcatgagccgctggatgatcggctgcagctcggggtcgtccatcatctgccgctgcagcgagtcgaagatctcctcgccgatcaacgcggccacccacagcatcgatccgcgttggaaggccagcggcagcgcgttgatgatgtagcggtgaaaacgcttcggctgcaccggttttgcgcccacacgttcgatggccttgccgaacatgaccatgtggcgggtctcgtcacccagctcggtcagcttgtagtgggtggaccggctggtcgggtcttcgtgcaggatggtgcgcagcagcgactggttgagcatgttctcgaaccagatgccggccgacagcgtgttgaccaattcctggcgggacagctcgatttgttgttcgcgggtcatctcgtcccacatcggcgtgccgtacagcgacaccagccggggcggcaggaagaacttgtccgggtcgagcggggcgtcccagtcgatgtcgacgacgggttcgtaggacttcttgaccgagcccttcagcagccgctcggagaactcttcgcgactcggtccggtgggcctcgcgtcgcttcggatcgtctcggcgcgcgtcatggtcgggtcctcctgatcgcttggcatcgtcgcctcgggcgcttcagacggtacccatggtactgggtacttgcggtcccgactaggcccttgcggtatcgattcggcaatgtgggcgacagaagcaagtcaggagggtcgattggggcggcacatccacgtcatcggcatcggggccggcgaccccgactacctgaccgtgcaggcgatcgaggcgctcaacgacacccaggtgtttttcgcgatggacaagggcgagcagaagagcgacctggtggcgctgcgacgcgagatctgctcccggttcatccgtcagcccggctaccgcttcgtcgagctgcgcgacccgaagcggtccgaccgcgccgactaccgcgacgcggtagcggaatggcatgccgcgcgcgcgcagatctgggccgacgccatcgccgccgaactcggcccgcacggcgtcggcggctttctggcctggggcgatccgtcgctctacgacagcacgttgcgcatcctggacaccgtcgccgggcacgtcgaattcaccttcgacgtgatccccggcatcaccgccgtgcaagcgctgaccgcccggcatcgcatcccgctcaacgaggtgggcgagcccgtgctcatcaccaccggtcgccagctgcgcgcccacggcatatccggctcggcggtggtgatgctcgacgccgactgctcgttccagcggtgtgcgcccgagacccgcatctggtggggcgcctacctgggcaccgccgacgaactgctggtcgccggcaccgtcggcgaggtggggccccgcatcgcggcgctgcgcgcgcaggcccgcgcccggcacggctggatcatggacacctatttgctgcgaccggcacactgaaaccgtgcccgaactgcccgagatcgaagcgctggccgaccacctgcggcgccatgccgtcgggctgccgatcggccgggtcgacgtcgccgccctgtccgtgctcaagacgttcgacccgccgatcagcgcgctgcacgggcagaccgtggtgggcgccgagcgctggggcaaatacctgggcctgcggaccgagggccttttcctgatcgcccatctgtcccgggcgggctggttgcgctggtcggaccggctgaccgcggcgccgctgcggcccggcaagggcccgatcgcactgcgggtgcatctgggcacacccggcgcggcccccggcttcgacctgaccgaggccggcacccagaagcggctggcggtgtggctcgtcgacgacccggcgcgggtgcctgggatcgccgccctgggcccggacgccctggacctggacgtcgacgcgctggccgacctgctggccggcaacaccggccggatcaagacggtgatcaccgaccagaaggtgatcgccgggatcggcaacgcctacagcgacgagatcctgcacgtcgcgaagatctccccgttcgccacggccggcaagttgtctgacaaacagctggccaccctgcatgacgccatggtcacggtgctcaccgacgcggtgagccggtccgttggccagggggcggccatgctcaagggcgagaagcgttccggattgcgggtgcatgcccgtaccgggttgccgtgcccggtgtgtggcgacaccgtgcgcgaagtgtcgttcgcggacaagtcttttcagtattgcccgacgtgccagaccggcggcaagatcctggccgaccggcggatgtcgcgtttgctgaagtagccgccggccgcggacttgacacctgtcgatatgctgccggagatgactcgccagaagatcctcatcaccggcgccagctcgggcctgggcgccgggatggcgcgcgcgttcgccgccaagggccgcgacctcgcgctgtgcgcgcgccgcgccgaccggctcgacgagctcaaagccgaactgtcgcaacggtatccggcaatcacggtcgcggtcgccgcgctggacgtcaacgaccacgagcaggtgcccaaggttttcgccgaactcagcgacgaactcggcggcatcgaccgcgtcatcgtcaacgccggcatcggcaagggcgccaagctgggctccggcaagctgtgggccaacaaggcgaccatcgagaccaacctggtgtccgcgctggtgcagatcgagaccgcgctggagatgttccacaagaacgggtcgggccacctggtgctgatctcgtcggtactcggcaacaagggagtgcccggcgtcaaggcggcgtacgcggcgagcaaggccggcctgagctcgctgggtgaatcgttgcgcgccgaatacgccaaggggccgatcaaggtttcggtgctcgagcccggctacatcgagtcggagatgacggccaaatccaacagcacaatgttgatggtggacaacgaaaccggggtcagggcattggtcgccgccatggagcgggagcccggccgcgcggcggtgccgtggtggccgtgggcgccgctggtgcagttgatgcgggtgctgccgccgcggctgaccaagatgttcgcctgagtcagctggtgcggccgcgttcgctgcggtagcggcgcaccagggcgtcggtggagctgtccgactgcggcgccggcgagttgtttgcggtgatcaccggaagcagcgcctttgcctgggtcttacccagctccaccccccattggtcgaacgagtcgatgccccagatcacgccctcggtgaagacctggtgttcgtagagcgcgatcaactggcccagcaccgacggcgtgagccggttggccaggatcgaggtcgacgggcggttgccgggcatcaccttgtgcggcacgatgtcggccggagtgccttcggccgcaatctcttcggcggtcttgccgaacgccagcacctgggtctgggcgaagaagttgctcatcaacaggtcgtgcatgctgccgctgccttcggcggtgggcagatcgtcgatcggttgactgaaaccgatgaagtcggccggcaccaaccgggtgccctggtgcagcaactgatagaaggcgtgttgaccgttggttcccggttcgccccagaagatttcgccggtgtcggtggtgaccgggctgccgtccgcgcgggtggacttgccgttggattccatcgtcagctgctgcagataggccgcgaaccgggccaggtcgttggaatacggcagcaccgcgcgcgactgcgcgcccatgaagttggagtaccacaagccgataagcccaagcagcacaggggcattggattccagcggcgcggtctggaaatgccggtcgacgatatggaacccggacaggaaatccgcgaaggcctcccggccgatgacggccatcaccgaaaggccgatcgccgagtccaccgagtaacggccgcccacccagtcccagaacccgaacatgttgtcggtgttgatgccgaagtcgtcgaccaggcgtttgttggtggagacggcgacgaaatggtgcgccacggcggcgtcgccgagggcgtcggtgatccagcggcgggcggccgtggcgttggtgagggtttccagcgtcgagaacgtcttggacgcgacgatgaaaagtgttgtggcgggatccaagtcggccagggtggcgatcaggtcggccgggtcgacgttggacacgaagcgcgccgagattcccgcgtcggcgtagtggcgcaacgcctggtacaccatgaccgggccgaggtcggatccgccgatgccgatgttgacgacggtgctgatccgcttgccggtcgctccggtccattcaccgctgcgcaaccggtcggtgaactcgcccatggcgtcgagcacctcgtgcacgtccgcgacgacgttgcggccgtccacgatcagttccgcgtcccggggcagtcgcagcgcggtgtgcagcaccgcgcgatcctccgaggtgttgatgtgcaccccggcgaacatctggtcgcggcgctcttcgagtttggccgtgcgggccagatcgaccaagagccgcaaggtttctcgggtgacgcggtgcttgctgtagtcgatgtagaggtcaccgacggtcactgtcagctcgcggccacggtcgggatcttcctcgaagaactggcgaaggtgggtgtcgccgatgcggtcgtgatgtttgcgcagggcgtcccacgccggggtggcggtgatgtcgggcagggtgtgcacggatgtcatgggcgccgctcctcctcatcgcttcgcgtcgccgacgcggctcatggttcagaccctatgggttgcgacggaacggagccaggtcgcgcgacgtgcgcggcgccgccgacgtcagtgcccgagccggcctcgacccagccgcagcagcagcatggccaggtctttgccgtcgggacccagctcgctgtagcgctcgatgaccttcatctcccggctgtggaccagccgggtgccgcccgatgccatgcgcgccctgccgatcgcctgcgacacctcggtgcgtcgcttcaccgcggccaggatctccgcgtccaaccggtcgatctcccggcgcaactggtcgatgtcggtggcctcacggggatccaccgtttccgtgttcatctctgctgactccgcgtcgtcgtcgtcatctggggattggggtctcatgcagtatcaggcctcaggagaagacgagccccgcgcggggctctgcggaagcagtcagaccacggccgccgcggaccggtgtccgtgggcggatcgacggcgccattttgggctggacaaccgccggtaacactgcacggtgagcaccaaatgagtgtgccactagatccggtacgcgcgcaaaaaaccgcagttgagctgcgtctttttgactcgggtgtaattgtgccggcgggccggtcggcgggccgcgtcaaccgtcgcgacacgccgtcgctcccggcggcccggtcggcccggcggcgggcggccggaacactaacctggttggacgactgggcgctgtgcgtcggtgggcggcggtaagtttgaactgacatgagtgtgcacgtaacagatgccaagccggtctccgaagccgagcaattgctcgaggggctcaatccgcaacagcgccaggccgtggtgcacgagggttcgccgctgctgatcgtcgccggggcgggttcggggaagacggcggtgctgacccgccgcgtcgcctacctgatcgcggcccgcggggtcggggtgggccaggtgctggccatcaccttcaccaacaaggccgccgccgagatgcgggaacgggtggtgcggctggtgggcaaccgggcccgcgccatgtgggtgtccacctttcattcgacctgcgtgcgcatcctgcgcaaccaggcgtcgctgatcgagggcctcaattccaacttctcgatctacgacgccgacgactcgcggcggctgctgcagatgatcggccgcgacatgggcctggacatcaagcgctactcgccgcggctgttggccaacgcgatctccaacctgaagaacgagctgatcgaccccgccgcggcggtcgccaacctcaccgacggttccgacgagttgtcccgcaccgtggcaagcgtctacggcgaataccagcgccggctgcgggcggccaacgcgctggacttcgacgacctgatcggcgagacggtggcggtgctgcgggccttcccgcagatcgcccagcactaccggcggcggttccggcacgtgctcgtcgacgagtaccaggacaccaaccacgcgcagtacgtgctggtgcgcgagttggtgggcaccgacaccgaggacggcgttccccccggcgagctgtgcgtggtcggcgacgccgaccagtcgatctatgccttccgcggcgccaccatccgcaacatcgaggacttcgaacgcgactacccggacgcgacaaccattctgctggaacagaattaccgctcgacacagaacatcctgtcggcggccaactcggtgatcgcgcgtaactccggtcgccgcgacaagcggctgtggaccgacgccggcgccggcgagctgatcgtcggctacgtcgccgacaacgagcacgacgaggcccgcttcgtcgccgaggagatcgacgcgctcgcgcagaagggcgagatcacctacaacgacgtcgccgtcttctaccgcaccaacaactcgtcgcggtccttcgaggaggtgttcatccgcgccgggatcccctacaaagtcgttgggggagtgcgcttttacgagcgcaaggagatccgcgacatcattgcctacctgcgggtgctggacaaccccggcgacgcggtgagcatgcggcgcatcctcaacaccccgcgccgggggatcggtgatcgggccgaggcctgcgtggcggtgtacgccgagaacaccggtgccagtttcgccgacgcgctggtggccgcggccgaaggcaaagtgccgatgctgaattcgcgcgcggagaaggcgatcgcgggtttcgtcgagttgctggacgacctgcgcggccggctggacgacgatctcggcgacctggtcgagtcggtgctcgaacgcaccggctaccgccgggagctggaatcgtccaccgatccccaagagctggcgcgtctggacaacctcaacgaactcgtcagcgtcgcacacgaattcagcaccgaccgggcgaacgccgccgcgctggacgagtcgctggatgccgcggacgacgaagacgtgcccgacaccggtgtgctggccgagttcttggaacgggtctcgctggtctccgacagcgacgagatccccgaggacggcgccgggatggtcacgctgatgaccctgcacaccgcgaagggcctggagttcccggtggtgttcgtcaccggctgggaggacgggatgttcccgcacatgcggtcgctggacgatccggtcgaactctccgaggagcggcggctggcctacgtgggcatcacccgggcccggcagcggctctacctgagccgggccatcgtccgctcgtcgtggggccagcccatgctcaacccggaatctcggttcctgcgggagattccgcaggaactgatcgagtggcggcgcaccgcgccggcgccgtcgttcagcgcaccggtcagcggcgccggccggttcggcaccccgcgggcggccccgacccgcgccgcaatgagcaaacggccgctgctggtgctggcgccgggcgaccgggtgacgcacgacaagtacgggctcggccgggtcgaggaggtgtccggcgccggcgagtcggcgatgtcactgatcgacttcggcagctccgggcgggtgaagctgatgcacaaccacgccccgatcagcaagctctaaccgcgccgagcgtgcattcagtgcgagaaaatcgcccgcgaaatcttcgccgtcagtgcgcattcggcgacgctcaggcgtccagccagcgtttggcctgcggcaacagcaccagcaccaccgtggcgatgggcaataccggcagcaggtgcaccacccaggccacccgggcgccggcgatgaacacgccgatataggtgagaaaagcgaccagcgcgccggccagcagcaggtagcggctgaccgagcggcgctgcagcagcccgatcacccccgacaccgtggtggcggcgaataccagggcgaggaacccgaccgcgatgcagaacagccggtccgaccgccaccacccggcgattaggtcggtggccaccaccgaggtggcccagccgctgacgatggcgaccgcgcaggcggcgacggccgtccggtcgctgggctcgagtgccggcagcccggagtagccggttcgtcccgcgcgggggccgccgcgatacgacggcggttgcggagcgaagtgagtggtcggtgaatccggcgtgacgggaatcggcccggtcggcgcgcggcggatgatccgggtccgtgtgtcggagggcggtgacggctccgcagcgggctcggagggacgcggaccggaaggtggatcgttcggcgcggtcacctcaaccagcgtagttgccgaccataaggccacgcttagccagccacggcaccgggtcgatgcgctcggtgccgccctgcagcacctcgaagtgcaggtgcgggccggtggagttgccccggttgcccatggtggcgatctggtcgccggccatcacccgctcgccgacgctgaccagcgcggtgttgatgtggccgtagagcgtgacggtgccgtcggcgtgccgcagcttgaccagcatcccgtacccgcccgccggcccggcctcgatgacgacgccgtcggacaccgcgtagatcggggtgccgatcgagttggccaggtcgatgccggcgtgcagcaccccccagcggtagccgaagttggaggtgaagatgcccttggtcggcatcacgtagagcggttgctgcaggcgtgcctcgcgctgcgcgcggtcgttggcgaaggcgacgcccttggccagctcctggttgtgcagggcggcggtggccgccggctcggccgcgatcacctgggggccgcggacggtgttgctgccgcccgccccgccggtgagcgaggacgcgttggcggtcagcaccgcgtcggtcttcggggtgtcggcgtggctggtggcggtgtgggcggcggccgcggtggcacccgcggccatcgccgagatcagcagccggccgcgggccgcgctggtcggttgcttgcgatgctgcccgccgcggcgggccacccccaccacgtcggcgccgcgcgggcgctccggccgccgctcggtgcgggccgcgacggtggtccggggcagcacctcggtgaccggagcggccagccacagcggccgcaggtcgtcggtctcgttcagatcgtcgagctcgggcgccagcaagacctgcgcctcattgtcgaagggggagtcggtgctgaagtccaggtcgccgtgatcgccggcgtcgtcacagaaatcaaggtcgtcgaagtcgaatccgtccagcgggagaatctcggtgacttcggttcgatggggttccgccgaccgggcgcctgccgcgcgacctaccctcacgacgcctgttgttacggcagaagagcgggcaaaacggtgctgggacaacctgaaatgtcctcgtatcgtgaccataacgttatctggaccctaggaaggtatctgctgacgcgcgggactggcaacctcgtcgcacaaacccgacggaattgtgatttggatcacctagccggtctatccgggtcccgtgagctgtgccacatcggcggacgcggcggtagcagcggtttggcgggtggatacagttcgtccgtgcgagttgccgattgcggcaccgcccaccaagaggcctagtagttgagtcgagcgaagacagagagtccatggaccttttcgagtatcaagcaaaagaattgttcgccaagcacaacgtaccgaccacgccgggacgggtgaccgacaccgccgagggtgctcgggacatcgccgccgagatcggccgtcctgtcatggtcaaggcgcaggtcaagaccggtggccgcggcaaggcgggcggcgtgaaatatgccgccacgcccgaggacgcctacacccacgccaagaacatcctcggcctggacatcaagggccacgtcgtcaagaagctgctggtgtccgaggccagcgacatcgccgaggagtactacatctccttcctgctggaccgcgccaaccgcacctacctggccatgtgctcggtcgagggcggcatggagatcgaagaggtggccgccaccgagcctgagcggctggccaaggtgccggtggacgccgtcaccggcgtggacctggcgaccgcgcggtccatcgccgagaagggccacctgcccgccgaggtgctcgacgcggccgcggtcaccatcaacaagctgtgggagctcttcgtcgccgaggacgccaccctggtcgaggtcaacccgctggtgcgcacccccgacaaccagatcctggcgctggacggcaaggtcaccctggacgccaacgccgacttccggcagcccggccacgccgcgttcgaggaccgcgacgccaccgacccgctggagctcaaggccaaggaacacgacctcaactacgtgaagctggacggccaggtcggcatcatcggtaacggcgcgggcctggcgatgtccaccctggacgtcgtcgcctacgcgggcgagaagcacggcggggtcaagccggccaacttcctcgacatcggcggcggcgcgtcggcggaggtgatggccgcgggcctggacgtcatcctgcacgacaagcaggtcaagagcgtgttcgtgaacgtgttcggcggtatcacctcctgcgacgccgtcgccaacggcatcgtgaccgccctgaacatgctcggtgacgaggcgaacaagccgctggtggttcggctcgacggcaacaacgtcgaccagggtcgccgcatcctcgccgaagccaaccacccgctggtgatccaggccgagaccatggactccggcgccgacaaagccgccgagctggcgaacaagtaagggagccaagccatgtcgatctttttgaacaaggactccaaggtcatcgtccagggcatcaccggcggcgagggcaccaagcacaccgcgctgatgctcaaggccggaacccaggtggtgggcggggtcaacgcccgcaaggccgggaccacggtttcgcacgtggacccggtcggcaaggacgtcgaactgccggtgttcggcacggtgtccgaggcgatgaaggagaccggcgccaacgtgtcggtggtgttcgtgccgccgaagttcgccaaggacgccatcatcgaggccatcgacgccgagatcccgctgctggtcgtcatcaccgagggaattccggtgcaggacagcgcatatgcgtgggcctacaacgtggacaagggtcagaagacccgcatcatcggacccaactgcccgggcatcatcacgcccggtgaggcgctggccggcatcaccccggccaacatcagcggtcccgggccggtcgggctggtgtccaagtccggcaccctgacctaccagatgatgtacgagctgcgcgatttcgggttctccacctcgatcggcatcggcggtgacccgatcatcggcaccacccacatcgacgccatcgaggcgttcgagaaggaccccgacaccaagatcatcgtgatgatcggcgagatcggcggcgacgccgaggagcgcgcggccgactacatcaaggccaacgtgtccaagccggtcgtcggctatgtcgcgggattcactgcgccggaaggcaagacgatgggtcacgccggcgccatcgtgtccggctcgtcgggcaccgcggccgccaagaaggaggccctggaggccgccggcgtcaaggtcggcaagacgccgtcggagacggccgcgctggcccgagagatcctgcagagcctgtagcggcccgcggtggggccccggattttgccggggcccggcccgcggtagatagtgggtctatgaatctcgaccccaacacccccgtcatcgtcggggtggggcagttcaccgagcgcatcgaggactccgggtaccgcggcatgtcgtcggtggagctggcgacggaagcggcgcgggccgcgctgcacgactgcggggccgacgccaccgccctcgccgcggccgtcgacaccgtcgccgcgatccggcaattcgagctgtccgggcgcacgcctgcacccatgggtaagtccaacaactacccgcggtcggtcgcgcggcggatcggcgccgccccggcccgcgccgtcctcgaacccatcggcggccagggcccccagcatctggtcaccgagttcgccggcatcatcgccgcgggggacgccgaggtcgtgatgatcttcggctccgaaaacacttccagcatccggtatttcgccgaccgggagaagccggaccactccgagacggtcgagggttccctcgaggaccggggtttcggctacgaaggcctgttcgacgactacaccgtcgcccacggcctgatcggcgcgccggcccagtacgggctgctggagaacgcgcgccgcgcccggctgggcttgagcgtggccgactaccggcgccggatgggcgagctgttcgccccgttcaccaaggtggcggccaagaacccgtccgcgtccgccccggtggaacgcagcgtcgacgagctcatcacggtgaccccgtccaaccggatgatctgcgatccctacccccggctgctggtggcccgcgaccaggtcaaccagggcgcggcggcgctgttgatgtcggtggccgccgcgcggcggctccgcgtgcccgaggagcgctgggtgttcctgcacggacacgcggacatggtggaccagccgctgctggaccgcctcgacctgacctacaactcggcgtcggtgctggcggtccaggaggcgctggccggggcgggcatcggcatcgacgacgtctcgacgttcgatctgtacagctgcttcccggtgccggtgttcaacttctgcgacggcacgggcctggccaccgacgatccgcgcggcctgacgctcaccggcggcctgccgtacttcggcggaccgggcaacaactactcgctgcacggcatcgccgagacggtcagcgaaatgcgggaccggccaggccaattcggcttggtcgccgccaacggcgggatcatgagcaagtactccgtcggggtgtactcgaccacgccggtgaactggaaacccgacaacagcgccgcgctgcgcgccgaggtcgccgcccgtcccacggttccggtgaccgtcagggcggacggtcgcgcgaccatcgagacctacaccgtgcgctacgactggccggtgcgcaccggcatcatcatcggccgcctcgacgacggcagccgctttttggccttgaccgaggatcccgagctggtcggcctgctcagcgacggcgagccgctcgggacgtcgatcgtggtcacggcgaccgagaaggacaaccgggccacgctggcctgattccgcggcgcgtgcctggcctgggcgtcacgtccgtggcctgggtcgttgtcacaccagggcggcgagcttgccggccagccgctcgacgtaggcggcgacctcgtcctcggacttgtccggcaggccgaacagcacttcggttaccccgagctcggcccatcgggccagcttctcggcgtccggcttgaagtcgagcgccacgatctgcggggcgccgtcgcggccggcggccgcccaggtgtcctgcagcagcttgaccggttcgtcgatgtcgaaatcgcgcggcgtggtgatccagccgtcggcgctgcgcgcgatccatttgaaattcttctcgttgccggctgcgcccaccagcaccgggatgtgcggctgcaccggcttgggccaggcccagctgggcccgaacttgacgaactcgccgtcgtagctggcttcctcgtcggtccacagcgcccgcatcgcttccaggtattcgcgcagcatggtgcggcgccggcccgccggcacgccgtggtcggcgagttcgtcggtgttccagccgaacccgacgccgaggctgacccggccgccggacagatggtcaagggtggcaatacttttcgccagcgtgatcgggtcgtgttcgaccggcagggccaccgcggtggacagccgcacccgcgaggtgacggcacaggccgcgcccagactgacccacgggtccagggtgcgcatgtagcggtcgtcgggcagcgacgcgtcgccggtggtcgggtgcgcggcctcccgcttgatcgggatatgcgtgtgttccggcacgtagaaggtcgcaaacccgtggtcgtcggcaagcttcgcggccgcagccggagagatgccacggtcgctggtgaaaagcacaagcccgtaatccatgcagtgaattagaacgtgttctacctctgcggggcaagctgtcgtgatacggaccgtctcgccgcgcggtcgtctgcgaagcccgcgggcaagccaatggcgacggcaccggccgtcgcacgtgcgctagcgtgggtgatcgaccgtgtcgctcgcgcagtgacgcgcctgcaagcaccgcgtcgcatcgcaaccgtggcgcccgctcggcactaaaaggcagtggaagcaacaggaggagccatgacctactctcccggcagccccggatatccaccggcgcagtctggcggcacctatgcaggcgccacaccatctttcgccaaagacgacgacggcaagagcaaactcccgctctacctcaacatcgccgtggtcgccctgggtttcgcggcctacctgctgaatttcggccccaccttcaccatcggcgccgacctcggcccgggtatcggcggccgcgcgggtgacgccggcaccgccgtcgtggtggcgctgctggccgcgctgctcgccgggctgggcctgctgcccaaggccaagagttatgtgggcgtggtcgcggtcgtcgcggtgctcgccgcgctgctggccatcaccgagacgatcaacctgcccgccggtttcgcgatcggctgggcgatgtggccgctggtggcgtgcgtggtgctgcaggcgatcgccgcggtggtcgtggtcctgctggacgccggggtgatcacggcgccggcgccgcggcccaagtacgacccctacgcgcagtacggccaatacgggcaatacggccagtacgggcaacagccctactacggtcagccgggcggtcagcccgggggccagccgggtggtcagcagcattcgccgcagggctacgggtcgcagtacggcggttacggccagggcggcgctccgaccggcggtttcggtgcccagccgtcgccgcagtccggcccgcaacagtccgcgcagcagcagggcccgtccacaccgcccaccggcttccccagcttcagcccgccgcccaacgtcggcgggggatcggactccggttcggcgaccgccaattactccgagcaggccggtggccagcagtcctacggccaggagccttcttcaccgtctgggccgacgcccgcctaacgtgccctgtcgcgcctagtcgggaacgtgccccagagtgacacgggtggaggacaaccgggcagcgggcgctcgccaggcgcgtgacctcgtcagggtcgcgttcgccccggcggtggtggcactggtcatcatcgccgcggtcacgctgatccagttgttgatcgccaacagcgacatgaccggcgcgttgggcgccatcgccagcatgtggctgggcgtgcaccaggtgccggtgtcgatcggcggccgcgaactgggtgtgctgccgctgctgccggtgttgctgatggtgtgggccacggcgcgcaacaccgcgcgggccacctcgccgcactcgtcgtggttggtcattcgctgggtggttgcctcggcgctgggtggcccgttgttgatgacggcggtcgcgctggccgtcatccacgacgcgtcgtcggtgatcaccgagttgcagacgcccagcgcgctgcgggcatttctgagcgtgctcgtggtgcatgccatcggcgccgggatcggggtgtggtcgcaggtcgggccgcgcgccctggcggcgtcgtcgctgccctattggctgggtgattcgttgcgcgccgcgaccgccggcgtcctggcgctgctcgggctgtccggcttcgtgaccgccgggtcgctggtggtgcattgggcgaccatgcaggagctctacgggatcaccgattcgatcttcggcgagttcagcctcaccgtgttgtcaatgctgtacgcccccaacgtcattgtgggcaccgcggcggtggccgtcgggtccagcgcgcacatcggtttcgcgacgttcagttcgttcaccgtgttcggcggggacatcccggcgttgccggtgctcgccgccgtgccccggccgccgctgggaccggtgtgggttgcgctgctcatcatcggggcgtcgtcgggcgtggcggtcgggcagcagtgcgcgcggcgcccgctgccgcccgttgccgcgatggtcaaactgctggccgcctcggtggccggggcgttggtgatgtcgctgctcgccttcgccggcagcggccagctgggcaacttcgggcccgtcggcgtggaccagggtgcgctgttggtcggggtcttcttctggttcgcggtggtcggcggggccacggtggtgatgagcggcgggatccggcgccccacccgacggctcaagccgcgccccgcgcccgcggcgccggtggccgaggagcacgattccgtcttcggcgaggcggtcgggcccgttggtgacgttgcgggcgtcgacgaggttgcggtggagggtgtcgacgaggttgcggcggggggtgtcgacgaatccccgggcgatgcgggcgagcgtgagggtgacgagggtgatcccggggagcgcgggccgggcgacgcgggcgatgcgggcgagcgccggcccggggaataggaactttgcccgcctctgagcgacaacgacgcgtcgggggatcggacttcggtgattgtcgctcagaggcgggcacttcccatgtgccccgccggcccggcgcgccggattgtcgggctcctcagcgtgccgtgacggcacgcatcgtcgcccgactaggctcgccgatgtggtcgaaccgctgcatgtgccccccaatgcgccggcgcgggtggtggtgctggcttcgggtaccggatcgctgctcagctcgctgatcgacgccgccgtgggcgactacccggcccgggtggtcgcggtcggcgccgaccgcgactgcctggccacccagatcgccgcggccgcctccctgccctccttcaccgtccggctcggcgaccaccctgaccgcgccgcctgggacgccgcgatcaccgaggccaccgccgcccactcgcccgacctggtggtatccgcagggtttatgaaaattcttgggccgcaatttctttcacgcttctacgggcgggtcatcaacacgcatccggcgctgctgccagccttcccgggcgcacatggcgtggccgaagcgttggcctacggcgtgaaagtcacaggctgtacggtgcacctggtggacgccgggacggacaccgggccgattttggctcagcaatccgttccggtgctcgacggcgacgacgaacagacgttgcacgaacgcatcaaagtcaccgaacgcaagctgctggtggatgtggtggctgcgatcgcgaccggcggcctgaccctggtcgggagaaaagcgacgatcggatgaaaggcgaccaaccgatgagcaccgacgactggcgggaaaacgccaaaaggccgatccgtcgcgccttgatcagcgtgtacgacaagaccggtctggtcgagctcgcccaggggctgaccgaggcgggcgtcgagatcgtctcgaccggttccaccgcgaaggtcattgccgagaaaggcattccggtgacccgggtcgaggtgctgaccggtttccccgaagtgctcgacggccgggtcaagacactgcacccgcgcgtgcacgccggactgctggcggatctgcgcaaacccgaacacgccgcggcgctcgagcaactcggcatcgccgccttcgagctcgtcgtcgtcaacctgtatccgttcaccgaaaccgtcgactccggcgccggcatcgacgaatgcgtcgaacagatcgacatcggcggcccgtcgatggtgcgggccgccgccaagaaccaccccagcgtggcagtggtcgtcgacccactcggctacgacggggtgctcgcggcggtgcgccacggcggattcaccctcgccgagcgtaaaaggctggcggcgttggcgtttcagcacaccgccgactacgacatcgcggtggcgacgtggatggagtcgacgctggcccccgaacatccgccgaccaccttcccgaagtggctgggccgcagctggcgccgctcggcgatgctgcgctacggcgagaacccgcaccagcaggcgtcgctgtacagcgacccgggtgcctggccgggcctggcgcaagccgagcagctgcacggaaaagagatgtcctacaacaacttcaccgatgcggacgcggcctggcgggcggccttcgaccatgaacaaacgtgtgtggcaatcatcaagcacgccaacccatgtgggatcgcgatctcgtcgatatcggtcgccgacgcgcatcgcaaggcccacgaatgcgatccgctcagcgcgttcggcggcgtcatcgccgccaacaccgaagtcagcgtcgagatggccgaatacgtcagcaccatcttcaccgaggtgatcatcgcccccgcgtatcagcccgccgccctggagatcctgacccgcaagaagaacatccgggtgctggtggcgtccgagccgctgaccggcggcaccgaactgcgcccgatcagcggcgggctgctggtgcagcagcgcgacgaactcgacgcgcacggcgacaacccggccaattggacgctggccaccggggcacccgccgacccggccacgctggcggacctggtgttcgcgtggcgggtgtgccgcgccgtcaaatcgaatgccatcgtgatcgccgccggcggcgccaccatcggcgtcggcatgggccaggtgaaccgggtcgacgccgcccggctggccgtcgaacgaggcggggaccgggtgcgcggcgcggtcgcggcttcggatgcgttcttcccgttccccgacgggctcgagacgctcaccggcgccggggtgaaggccgtcgtgcaccccggcgggtcggtgcgcgacgacgaggtgaccgcggccgccgccaacgccggcatcacgctgtatctcaccggggcgcgtcacttcgcccactagcgattggccgcgatgccggtgatgggggtcacaaacgcgtcgattctcagtacgatgcgttcgggggaggacccgacggcccctgcgagtttcctcctttcctttcgggcggtcgcggatcgacctaccttcccttttcgatacacggacggctggtcccgtccattttcgagaggaattgaaatgcgcgagattacgaaacgaacggctgctttctccgttgcgcttgcggccttcgcgctgatcggtggggcgtgcagcaagtcgaacaacgccgggcagacaaccagctcggcgagttcgtcggcgacctcctcggcgacctcgggaacctcggcgagcgcggcgccgtcggaaagcacgggcaccagcggcgccccgagttcgacgcagatcaacggcgccaacggcaccccgtacaccgtcgaggggccgatcctggccaagtacaacgccctcgacgacaaggcgcgcaaggacttgggcgccccgacgggcaacgagcagaagaacccggacggcggcgtctaccagcaattcgacggcggcgtgatcgtttccaagacgcaggcttacgtggtgtggggcaagatccgcgacaagtggaaccagctgggcgggtcgcagggccagttgggttacccgaccagcgacgaggtggacacccccgacggcgcgaagaagtcgacgttcgagcacggcaccatcacctggaagccgggtgacgccgaggccaccgtcaccaccggttaggtacgccgcgaaggccgggcgtccccacgatgcccggccttcgtgtcggcacgcagtgaacgcccttcggatgacgcgtctgggcgctcgtcgtagcgtggagtggtgacgtcaccgagcaacctgccccgcaccgtcggcgaattgcgtgccgccggacatcgtgaacggggagtcaagcaggaaatccgcgagaatctgctggcccgcctcgccgaaggcggcgacggtgaggccatctggccgggcatcctgggattcgacgacaccgtcctgcctcagctggagcgggcgctgatcgccggccacgacttcgtgctgctcggtgagcgcggccagggcaagacccggctgctgcgcgcgctggtcggcctgctcgacgagtggacgcccgtgatcgccggggccgaactgggcgagcacccgtattcgccgatcacgccggagtccatccgcaaggccgccacgctgggtgacgacctcccggtggagtggaagcaccgcagcgagcgctacaccgaaaaactggccaccccggacaccagcgtcgccgacctggtcggcgacatcgacccgatcaaggtcgccgagggccgcagcctcggggacccggagaccatcgcctacgggctgatcccgcgggcacaccgcggcatcgtcgccgtcaacgagctccccgacctcgccgagcgcatccaggtgtcgatgctcaacgtgatggaggaacgcgacatccaggtccgcggctacacgctgcggctcccgctggacgtgctggtggtggccagcgccaacccggaggactacaccaaccggggccgcatcatcaccccgctcaaggaccgcttcggcgccgagatccgcacccactacccgctcgagttgtccgcggaagtcggcgtgatcgcgcaggaagcgcacctgtccgcccacgtccccgactacctgatgcagatcatcgcgcggttcgcgcgttacctgcgcgagtccaactccgtcgaccagcggtccggagtgtcggcgcggttcgcgatcgcggccgccgaaaccgtcgcggccgcggcccggcaccgcggcgccgtgctgggcgagacggatccggtggcccgggtcgtcgacctgggcacggtgatcgacgtgctgcgcggcaagctggaattcgagtccggcgaggaaggccgcgaacaggcggtgctcgagcacttgctgcgccgcgcgaccgccgacaccgcgtcgcgggtgctgggcggcatcgacgtcgggtcgctggtggccgccgtcgagggcggctcggcggtgacgacgggtgagcgggtgtcggccaaggatgtgctggcggcgatccccagcctgccggtggtggacaagatcgccgacaagctgcacgcccgctcggagggcgaacgcgccgcggcgctcgaacttgcgctggaggcactgtatttggccaagcgaatcgacaaggtgtccggggagggccagaccgtctatggctaacaggggccactcgtcgcgatactcggcgtacaccggcggacccgatccgctggcgccgccggtggatctgcgggaggcgctcgaacagatcggccaggacgtgatggccggcacctcgccgcggcgtgccctctccgagctgctgcggcgcggcaccaagaacatgcccggcgccgaccggctggccgccgaggccaaccggcggcgacgggaattgttgcgccgcaacaatttagacggcaccctgcaggagatcaagaagctgctggacgaggccgtgctggccgaacgcaaggagctggcccgcgcgctcgacgatgacgcccggttcggtgaactgcagctcgatgcgctgccggcgtcgccggccaaggccgtgcaggagctttccgaatacaactggcgcagcagcgaggcgcgtgaaaagtacgaccagatcaaggatctgctcgggcgcgaaatcctcgaccaacgcttcgcgggcatgaagcaggcgctgcagggcgccaccgacgaggaccgtcagcgggtcagcgacatgctgaacgacctcaacgacctgctggacaagcacgccaaaggccaagactcccagcaggacttcgacgacttcatggccaagcacggcgagttcttcccggagagcccgcgcaatgtcgaggagctgctggattcgttggccaagcgcgccgccgccgcgcagcggttccgcaacagcctcagcgccgagcagcgtgccgagctggatgccttggcgcagcaggctttcggctcgcccgacctgatgcaggcgctgaaccggctcgacgcgcatctgcaggcggcgcgtcccggggaggactggggcgggtccgagcagttctccggcgacaacccgttcggcatgggcgagggcacccaggcgctggccgacatcgccgagctggagcagctggccgagcagctgtcgcaaagctacccgggcgccaccatggatgacgtcgatcttgacgcgctggcacgccaactcggcgaccaggcggccgtcgacgcccgcacgctcgccgagctggaacgggccctggtcaatcagggctttttggaccgcgggtccgacggccagtggcggctatcgccgaaggccatgcgccgcctgggtgagacggcgttacgcgatgtggcacaacagctttccggccgccgcggtgaacgtgaccaccggcgcgcgggggcggccggcgaactcaccggcgccacccggccctggcagttcggtgacaccgagccgtggaacatctcccgcaccctgaccaacgccgtgctgcgccaagccgggacggccactctggacggaccggacgggcggttgaagatcaccgtcgacgacgttgaggtctccgaaaccgagacgcgcacgcaggccgcggtcgcgctgttggtggacacgtcgttctcgatggtgatggagaaccgctggctgccgatgaagcagacggcgctggcgctcaaccatctggtgtgcacccggttccgttcggatgccttgcagatcattgcttttggccgctacgcccggacggtgaccgccgccgagctgaccgggctggagggtgtgtacgagcagggcaccaatctgcatcacgcgctggcgctggcgggccggcatctgcgccgccaccccaacgcgctgcccgtggtgctggtggtcaccgacggtgaaccgaccgcgcacctggaggacttcgagggcgcgggcacgaccgtgttcttcgactaccccccgcacccgcggaccatcgcgcacaccgtgcgcggcttcgacgagatggcacggctgggcgcgcagatcaccatcttccggctgggcagcgaccccggcctggctcggttcatcgaccaggtggcccggcgcgtcgaggggcgcgtggtggtgcccgacctcgacggattgggagcggccgtggtgggcgactacctgcggtcccggcggcgtcgatagcgacaccggtcgcgcgactgagtttgactgtgaaggaggaaaacccgggtgagcaaggttccgacgatcgaactcaacgacggtgcgcgcatcccgcagctcggcttcggcgtgtatcagatcaagcccgacgagactgccgcggcggtgcgggcggctctggatatcggataccgccacatcgacaccgccgaaatgtacggcaacgaacgggaagtcgctcagggtattcgcgacgccgggctggatcgatccgaggttttcgtcaccagcaagctcaacaacggatttcacgaacctgacgccgcgcgccgggcattcgacgccacgctgaacgccttgggctccgactacgtcgacctgtttctgatccactggccgctgcccacgctgtacggcggcgacttcgtttccacctggcgggttttggaggagttcgcccgcgacggccgcgcccgcagcatcggtgtgtcgaatttccaagtcgcacacctggagcggctcgccgccgaaaccgacaccgtgcccgccgtcaaccaggtcgaggtgcatccctacttcaccaacgagaaggtccgcggctacgcccgcgagcacggcctcgcgatcgaggcgtggtcgcccatcgcgcagggcggcgtgctcggcgatgcggtcatcaaccgcatcgccgacggtctcggccgcaccgccgcgcaggtggtgctgcgctggcacatccagcgcggcgacatcgtctttcccaagacggtcaacccggatcggatgaaatcgaacttcgaactgttcgacttcgagctggacgagcgcgcgatggaggcgatctcggcgctggaccgcggggaatccgggcgacgcggccccaacccggacaccttcgactacataccgcgctgacggcgcagcatcaaaaaggctgcgcgacaggccttttcgatgctgccaaaagatgcgctcctagggccgtggccggcgcgccttgcgcctgatgcccaccccgccccagagcgagaagccacggatgtgcaccgtcggcgcgcccggagtgccctggccggggacgtcgcggtcgaagtttcccatcacgccgcggccgtgcacctcgacgttgacctccggcggcagcaaaatgctttgcacgcccatgatggacatcgcgtggatgtcgacctcggtcgaggtgaagtcggcgtagcgcagatcgaccacgccgctgccccacagggtgaaggtggtcagcttcttcgggacgttccaccggccgcgccgctcgaagccgctcaacaaggccagcagcagcgtcgagggcgccggattcggtttgccgccgcggcgcgggctgatcggcgcgcccggcagatcggcccgcagctgatcgagttcctcgtacgttttggccgcataagccctggtcaggcggtcctcatagtcgttgagctgcagccggccctgctcggccgcatatgccagcaactgtgcaatctgtatgcgatcagtatcggcggcgcgcgacggctcgtcgcgcgtatcctccgcatcccgttgcgttgagttgctcatcacccacgagcctacgacgtccagcttttgctgcaagaggattggctaaactgcaaccttgcaccggcccgcgacgccgcgcggcccgtccggccgcatcccctgtttgacatctggctaacttatcggctggctaactcgtccagttgggtgaccgcttctccaggaacgccagcatgccttcgcgggcttcgtcggacacgaacagccgggcggattcctcggccagccgctcggcgtcccggtcgaagcgctccagcaccgcggcggtggtcagtgccttggacgccgcgaggccctgcggcgaaccgcggcccacgtcggcgacgagttggtcgaccgcggcgtcgacgtcctcggcggccatggtgatcaacccgatctcctcggcccgtcgggcgtcgaacttctcgccggtcaggtagtagcgcgcggccgcgcgcgccgacagcttcggcagcagcgtcagcgagatgatggccggggcgacgccgatccgcgcctcggtcagcgcgaagctgctgcgcgggccggcgaccgcgatgtcgcaggcgcctaccaagccgaacccgccggcccggacgtggccgtcgatcgcggcgatcaccggcagtcgggattcgacgatggcgcgcatcagggcggccatctcccgggcccgctcgacggccatgtcgtaggccgacgagggcgatccgccggacccggcctcgctgagatccgcacccgcgcagaaggtgccgccggtatgggccagcaccaccacgcgcaccgccggatccgacgaggcgtcgcgcagcccctgatgcaactggctgaccagcgcgctggacagcgcgttgcggttgtgcggtgagttcagcgtcagccgcgccaccggaccgccggtggcggcggggccggcgtagtcgaccagggcgtccatcgtctcagtagctgcggggcaggcccagcgaggtctgggcgacgaagttgagcaccatctcgcggctgaccggggcgatgcggcccagccgggccgaggccagcatggcggccacaccgtactccttggtgaggccgttgccgcccatcgactgcaccgcctggtcgaccgagcgggtagccgcctcggccgcagcatatttggccatgttggcggcctcggccgcgcccatgtcgttgccggcgtcatagagggtggccgccttctgcatcatcagcttggcgagttcgacctcgatgtggcactgcgccaacggatgtgacaggccctggtgcgcgccgaccggggtgccccacacctggcgggtcttgacgtattcggcggcccgggccagcgcgaaccggcccatcccgacggagctggctgcgcccatgatgcgttcggggttgagcccggcgaaaagctgtgcgatcgcggcgtcttcggcgccgacgagcgcatccgacggcagccgcacgtcgtcgaggaagacctggaactggcgttccgggctgatcaattccatctcgatcggcgtggcgctgaaaccgggcgcatcggtgggcagcacgaacagcgcgggccgcagcttgccggtctttgcctcctcggtgcgggccaccaccagcaccgcctgcgcctggtcgatgccggaaatgaaaaccttctggcccttgaggatccagtcgctgccgtcgcggcgggcggtggtggtgatcttgtgcgagttggacccggcgtcgggttcggtgatggcgaacgccattgtcagcgtgccgtcggcgatcccgggaagccagcgcttcttctgctcctcggtgccgaacttgctgatgatggtgccgttgatggccggcgacaccaccatcaacagcagcgcgctgcccgcggccgccatctcctccatcaccagagacagctcgtacatgccggcgcccccgccgccgtactcctcgggcaggttcaccccgagaaagccgagtttgcctgcctcggaccacaattcgtcagtgtgctcgtgggcgcgggccttcctcaggtagtactcgctgccgtagttggatgcccactcggctaccgccttgcgcaacgcctgacgctcttcgttttcgatgaagctgctgtcggtcactgtgcatctccttctgattgcggcgcttccactcttgccagcacagcgccgacttcgacttgctgaccggttttgacattgagctcggcgagcaccccgtcgactgggtcggcgatggtgtgctccatcttcatggcttccagccagatcagggactgaccggcggtgacggtgtccccgatcgcggcaccgagccggatgacgttgccgggcatgggcgccaccagcgagcccttttcgacggtcgaaccgggctcggggaagcgcggcagcacggtcaggtgcaccggcccgcgcgccgaatcgacatacacgtcggcgtcggcgccgtggtagcggcgcaccgagaagttgtgctcgacaccgtcggtgcgcagcaccacgtcgtcggccgtggccgacaccagctgcaccgacgggtcgtcgggcagaaccaaaccggttctggtgaaacggtattggacccgatgctcgtggccctcgtcgtcgcggtagtccttgagctgaaagcccgacggcaggttccgccagccgctggggacggcgcccagcaccggggcgtgagcccggttgcgcgcggcgtcggcgagagcggccgcgaccgccgacaggcgcaccgccgccgcgtcgcccagcggcgccgccagctcggccaggccgtgggtgtcgaaaaacgctgtgtcggtggcgccgtcgaggaacgccggatgccgcagcacgttcaccagcagatcgcggttggtgcgcacgccgtgcacccgggtgcgggtgagcgcgtcggccagcaccagcgccgcctgacggcgggttggcgcgtaggagatgaccttggccagcatcgggtcgtagtggatcgacaccgcgaatccgtcggtgatacccgcgtccagccggatgccgatccgccgccccagtgagccgaactcggcccggaccgagggcaccgcgaacgcgtgcaccacgccggcctgcggctgccaaccgcgggccgggtcctcggcgtacagccgggcctcgatcgaataaccctgggcagcagggggttccgcatccaggcgggcgccgtcggcgaccgcgagctgcagctcgaccaggtccagcccggtggtctcctcggtgaccgggtgttcgacctgcagccgggtgttcatctccaagaagtagaactctccgtcgtcatcggcgaggaactcgaccgtcccggccccggtgtagccgatggcgccggcggccagccgggccgcctcgaacagcttggcgcgcatccccggtgtgcgctccaccagcggtgagggggcctcctcgatgatcttctggtgacggcgctgaatcgaacattcgcgttcgccgaccgcccacaccgtgccgtgggcgtcggccagcacctgaacctcgacgtggtgaccggtgggcagatagcgttcgcagaacaccgtcggatcaccgaacgcggactgcgcctcccggcgcgcggcctccacttcgccacgcagggcggacaattcgtgcaccacccgcatgccacggccgccaccgcccgcggacgccttgaccagcaccggcagttgggcctcggtgacggtgtcggggtcgagctcgtcgagcaccggcactccggcggcggccatcagctttttcgactcgatcttggagcccatcgcgcgcaccgcatccaccggcggaccgacccaagtcagtccggcgtcggcgacagcggtcgcgaaatcggcgttctcggagaggaatccatatccgggatgtagcgcgtcggcgccggccgcgcgggcggcgccgatgatggcctcgatgttgaggtagtcggtggtgttcggcaaccgcacccgggcgtcggcttcggcgacatgcggcgcgccggcgtcggggtcggtgtagacggcgacggtgctcacccccagccgtcggcaggtagcgaacacccgtcgggcgatttcgccgcggttggcaaccagtactcgcgtgattcccatcgggctcacatccgaaagacgccgaagttcgacgtcccctcgatcgggccattggctatggcggacaaacacattcccaataccgtgcgggtgtctcgtggatcgatcaccccgtcgtcgtagagcattccggacagcaccaggggcagcgactccgcttcgatctggccttccaccgccgcccgcatcgccgcgtcggcctgctcgtcgaactgctggccgcgggcctcggccgccgctcgggccacgatggacagcacgccggccagctgggcgccgcccatcaccgcggacttcgacgtcggccaggcgaacaggaaacgcgggtcgtaggcgcgcccgcacatgccgtagtggcccgcgccgtaggaggcgccgatcaacagcgagatgtgcggcaccgtcgagttggacacggcgttgatcatcatcgacccgtgcttgatcatcccgccctcttcgtagtccttgcccaccatgtagccggtggtgttgtgcaggaacagcagtggcgtgttggagcggttggccagctggatgaactgggtggccttttgcgactcctcgctgaacagcacaccgcgcgcgttggccaggatgccgatcggatagccgtgcagccgggcccagccggtcaccagcgacgagccgtacagcggcttgaattcgtcgaactcggagccgtcgacgatgcgggcgatcacttcccgcggatcgaacgggatgcgcagatcggcgggcacgatgccgatgagctcttcggtgtcgaacagcggctcggtgaccgctttgggcgtgggtccctgcttgacccagttcaaccgggccacgatgcgccggccgatgcggatcgcgtcgagttcgtcgacggcgaagtagtcggccaaacccgagacccgggcatgcatttcggccccacccagtgattcgtcgtcggattcctcaccggtggccatcttcaccagcggcggaccggccaggaaaaccttggaacgttccttgatcatcaccacgtgatccgacatgcccgggacgtaggcgccgcccgccgtggagtttccgaaaaccaaagcgatggtggggattccggcggcggacagtcgggtgaggtcgcggaacatccgtccgccggggatgaagatctccttctgggtgggcaggtccgccccgccggactccaccagggagatcaccggaagccggttctcgaaggcgatctggttggcccgcaggatcttcttcagggtccacgggttgctggtgccgcctttgaccgtggggtcattcgccacgatcatgcattcgacgccctcgaccacgccgataccggtgacggtgctggcgccgaccttgaaggagctgccccaggccgccagggggctcagctccaggaacggcgagtcctggtcgaccagcagttcgatgcgttcccgcgccgtcagcttgccccgggcgtggtggcgttcaacgtatttcggtccgccgccggccagcgcgttggcgagttcggtgtcgatctcctcgagcttcgccaatgccgccgacgccgcctcggtgaagcccggcgcctttcggtcgagagcggactgcagcacggtcatgtccaccaccgacgatgcagagcgaagcgatgaggaggaggaggtgaaatcatgattggaatcccagcagtttggcggacaatgcgatcaggatttcggtggtgccgccgccgatgcccaggatcctcatgtcccggtattggcgttcgacctcggattcggccatgtagcccatgccgccgaacagctgcacggcctggttggcaacccattcgccggcctccacggccgtgttcttggcgaagcacacctgcgggatcagattcgtctcaccggccagctggcgttccaccacgttgcgcgaatacacccgggcgacgtcgatgcggcgggccatctcggccagcgtgttctgcaccgactgccgcgaaatcagcggccggccgaacgtctcgcggtcgcgacaccactgcaccgtcaggtccaggcaccgctgcgcactcgaatacgcttgtgcggcaaggccgatccgctcggagacgaaggcctgggctatttgggcgaacccggtgttctcggcgccgaccaggttggacaccggtacccggacgtcggtgtaggacagctcggcggtgtccgaggagcgccagcccatcttgtccagcttgcgcgtcacctcgaacccgggagtgcccttctcgaccaccagcaacgaaacccctgccgccccagggccgccggtgcgcaccgcggtcaccacatagtcggcacgcaccccggaggtgatgtaggtcttggcgccgttgacgatgtagtgatcaccatcgcgtaccgcggaggtccgcaggtgaccgacgtccgaaccgccgcccggctcggtgatggccagcgaaccgatcttctcgccggccagcgtgggccggacgaactcctcgatgagccgctgatccccggaggcgatcatgtgcggcaccgcgatgccgcaggtgaacaacgacgcgaacaccccgcccggcgctccggcctgatgcatctcctcgcagatgatcaccgcgtcggcgccgtcgccgcccccgccgccgaccgattcgggaaagccggcgcccaacagcccggccgccccggcgctgcggtgcaattcgcggggcagctcgccgctgcgctcccactcgtcgacgtgcggaaggatctcgcgttcggcgaacgagcgcaccgtctttcgcagttgttcgcgctcgggggtggtccacagattcacagcaggctctccgggatgtcgaggtagcggccgcgcagccattcgcccagccccttggcttgcgggtcgaaccgggcttgataggcgacaccctgtccgaggatgccgtcgatgacgaagttgaccgcgcgcaggttgggcagcaggtggcgggtgacggcgaactcggcggcctcgggcagcagctcggtgagccgctcgacggtcaacgtgtgggccagccagcgccactgctcgtcggtgcggacccagaccccgacgttggccgagccgcccttgtctccgctgggggccccggcgatagtacccagcggcgcgcggcgcaccgggccgtccggcagcggttcgggcagcgccgggtcatcgaccggcgccagctccaaagtatcggtggcgcaaggaatgtcgacccgggcgccgtcggcgtgcaccgcgatgtgcggcaccttatcggcgtcgacatagccggcggtgaacacgccgtacacctggccgtcggccggcggggcggtgacgtgaaatcccggatagctggcgagtgccaattcgactgcggccgaggagaattggcgcccgacattggccgggtcgggatcgcggacgacgcagtgcagcagggcgctggcggcctcttcggtgtcggcgtcgagatggtcggtgcgggccagcgaccactgcagctccgcgggtttgaccgccaacgcggactgcagctgccgacgcaccagctcggccttggcctcgatgtccaggccggtcagcacgaaggtcatcgagttgcggaatccgccgatgctgttcagcgacaccttgtaggtgggcggcggcggctcaccgcgcacgccgctgatgcgcacccggtcggggccgtcggaggacagctcgacggtgtccatccgggcggtgacgtcggggttggcgtaacgcgcgccggtgatctcgtacagcagttgcgcggtgacggtgtcgacgctgaccagcccgccggtgcccggatgcttggtgatcaccgaggagccgtcggcgtgcacctcggccagcgggaaacccgcgtgggtcaggtcgggcacctcggtgaagaaggaatagttgccgccggtggcctgcaccccgcactcgatgacgtggccggccaccaccgccccggcgagccggtcgtagtcgctgcgttcccagccgaagtgcgccgcggccgccccgacgatcaccgaggcgtcggtgacccggccggtgacgacgacgtcggcgccgtcgcccaggcagtcgacgatgccccaggcgcccaggtaggcgttggcggtcagcgggctgcccagccccagctcggcggcgcgcgccagcaggtcgtcgccctcgacatgggcgacccggacgtcgaggcgtagccgggcggcgaggtcgcggatcgcgtcggccaggccggccgggttgagtccgccggcgttggccacgatgcggaccccgcggtcgcgggcctcgcccaggcagtcctcgagttgggtcaggaaggtcttggcgtagccgcgctcggggtgcttcatccgatcgcggcccaggatcagcatggtcagttcggccaggtagtcgccggtgaggtagtccaccttgccgccggtcagcatctcgcgcatggccgacagccggtcgccgtagaacccggagcagttcgcgatgcggaccgcccccggatcgccgggaggaccgggaggagaggccatgcgtgtcctccattcgtgggcgtaccggtgaccgcgaaccaaccaaccaaccggtaggttatcgggtaccgccggtgtcgcgtcaaggacggtcgatcgtcggcgggcgtcgttttggtgaccagcaggccaacgactatcctgatgtccaatcgtcgcacgttcggcccgaccggccacgccgcgcgacatgcccgttcaagcccccgaccgaggagttaggcccgaccatggccgtacccaagcgcagaatgtcgcgcgcgaacacccgtagccggcgcgcgcagtggaaggcggagaagaccgagctcgtcggtgtgacggtggcaggtcagcggcacaaggtgccgcgcaggctgctcaaggcggcccgtctcggcctgatcgatctcgaccgccgctgaccttgatggcggcggcccgctgcgcccggctttcgccgcgctggcgaccgccgctgaccttgatggcggcgcgcctctcaggtcagtctcaggcggtgggacgaaactaggggccgtgcgaatactggtcgtcgacgacgatcgcgcggtgcgcgagtcgttacgcaggtcgttgtccttcaacggctactccgtcgagttggcccatgacggggtcgaggctctcgacatgatcgcgagcgatcgccccgacgcgctcgtcctggatgtgatgatgccgcgactggatggcctcgaggtgtgccgtcagctgcgcagcaccggtgacgacctgcccatcctggtgctgacggcccgcgattcggtctccgagcgggtggccgggctggacgcgggcgccgacgactacctgcccaagccgttcgccctggaagaactgctggcccggatgcgggcgctgctgcgccgcaccaagcccgaggacgacgccgaatccgtggcgatgacgttctccgatctgacgctggacccggtgacccgggaggtcacccgcgggcagcgccggatcagcctgacgcgcaccgagttcgcactgctggaaatgctgatcgccaacccgcgccgggtgctcacccgcagccgcatcctcgaggaggtctggggcttcgacttccccacctcgggcaatgcgctggaggtgtacgtcggctacctgcgccgcaaaaccgaagccgacggcgagccgcggttgatccacactgtgcgcggggtgggttacgtgcttcgggagacgccgccgtgacgagccgcccgccgcgatgatccggttgtaccggccccagcgccccccgttgcgcgcgcccctgcgcgccaccccctcgctgtcgctgcgatggcgggtgatgctgctggccatgtcgatggtggccatggtcgtggtgctgatggcgttcgccgtctatgccgtgatttcggccgctctctacagcgacatcgacaaccaactgcagagccgggcgcaactgctgatcgccagcggctcgttggccgccgaccccggcaaggcgatcgagggcaccgcctattcggacgtcaacgcgatgctggtgaaccccggccacgccatctacaccgcccagcagccgggtcagacgctgccggtggggtcgccggaaaaggcggtcatccacggcgaactgttcatgtcgcggcgcaccgcgggcgatcagcgcatcctggccgtgcacctgcagaacggcacgtcgttgctgatctccaagagcctcaagccgaccgaggcggtgatgaacaaactgcggtgggtgctgctgatcgtcggaggtgtcggcgtggccgtcgcggcggtggcgggcggcatggtcacccgggccgggttgcgcccggtggcccgcctgaccgaagcggccgagcgggtggcgcgcaccgacgacctgcggcccatcccggtgttcggcagcgacgaattggccaggctcaccgagtcgttcaacctgatgctgcgggcgctggccgagtcccgggagcgacaggcccggctggtcaccgacgccggacacgaattgcgcaccccgctgacgtcgctgcgcaccaacgtcgagctgctgatggcctcgatggagccgggcgccccgcggctgcccgagcaggagatggtcgagctgcgcgccgatgtgctcgcccagatcgaggaattgtcaacgctggtaggcgatttggtggacctcacccgcgacgacgccgggcaggtggtgcacgagccggtcgacatgtccgatgtgatcgatcgcagcctggagcgagtcaggcggcggcgcaacgacattcacttcgacgtcgatgtgacgccgtggcagatgtacggcgatgccgccgggttgtcgcgtgcggtgctcaacctgttggacaacgcggccaagtggagcccgcccggcgggcacgtcggcgtcacgatgcgccagctcgacccgtcgcacgtcgagctggtggtctctgaccacgggcccggcattccgccgcaggagcgccggctggtgttcgagcggttctaccgctcgacgtcggcgcgggccatgcccggctccgggctggggctggccatcgtcaagaaggtcgtgctcaaccacggcggcatgctgcgcgtcgaggacacggtgccgggcggccagccgccgggcacctccttctatgtgctgctgccggggcggtcgctgccgccggccggccactcgacgcccgccggcgagtcggaaaccgaccaggcggaggccgccaccgaccccgccgtaccggtggccggggacacggcgaactctcgggaatcggcgaacgttatctcagtggactctcagtccgcgcgggcaaggtaggtctgcggctactgttaaacccagccgagccgagcccaccgcgagccgaaacgccgagatagaggaagagcgacttagcgacatgacgaatgacccgaggtattcgccaccgccgcagcagcagccgggatacccgcccgcgccgaatcagactgcgcccgtcccgagccacgcgggctcctcaggctatgcccaggggcagcagccctaccagcagcaattcgactggcgctatcggtcgcagccctcgcaaaccacccagttccgctcgccctacgagcccttcggcaacgccgggccgggacgcgtccccggcggcaccggcaccggtccgctgcccggcatgcatcccgggatgcccgccccgccggaacctcaaaagcgttctcgcgcaggtctattgacggtgggagcggtggccatcgcggtggtgtcggccggcatcggcggtgccgcggcaacggccgtcgaaatgggcacccacgcaacgggcagcggcggcgggcgcatcgccggggcggcgcccagcgtcccggcggcgaacatgccgccgggcagtgtcgagcaggtggcggccaaggtggtgcccagcgtggtgatgctggagaccgatctgggccgtcagtccgaggagggctccggcatcatcctgtcgaccgacgggctgatcctgaccaacaaccacgtcgtcgcggccgcggcgggaccgcccaagggtcccgcggcgcccccggtggtcccgctgccgcccggcggcccgggcggtggtcccggcgccggcaccccgaagacgacggtcaccttctccgacggccgcaccgcgccgttcacggtggtcggtgccgaccccaccagcgatatcgccgtcatccgggtgcagggcatgtccgggctcacccccatctcgctggggtcgtcgtcggacctgcgggtcggtcagccggtggtggcgatcgggtcgccgctgggtctgtccggcacggtgaccaccgggatcgtcagcgccctgaaccggccggtgtccaccaccggtgagtccggcaaccagaacaccgtgctggacgctatccagaccgacgccgcgatcaaccccggcaactccgggggagcgttggtcaacatgaacggccaactggtgggcgtgaactcggccatcgccacgctgggcgccgactcgccggacgcgcagagcggctcgatcgggctgggcttcgcgatcccggtcgaccaggccaagcggatcgccgacgagctgatcgccaccggcaaggcgtcacatgcctcgctgggcgtgcaggtgaccaacgacaagggcaccccgggcgccaaggtcgtcgacgtggtgtcgggcggtgcggccgccagcgccggcctgcccaagaacgtggtcgtcaccaaggtcgacgaccgcccgatcaacagcgccgacgcgttggtcgccgccgtgcggtccaaggcgccgggcgacaagatcacgttgacgttctccgatcccgccggcggcggcagccggactttgccggtcaccctgggaaaggcggaccagtagtgagagtggacgaaccctcggcggcgggattgtcggagctcggatatacggttgcacccatggaaacgggtgcggagttggtagttggccgggcactggtcgtggtggtcgacgatcgcgccgcccacggtgacgaggaccacagcgggccgctggtgaccgagctgctcaccgaggcgggattcgtcgtcgacggtgtggtcgccgtcgccgccgacgaggtcgagatccgcaacgcgctcaacaccgcggtgattggcggggtggacctggtcgtctccgtcggcgggacgggcgtcaccccgcgcgacgtcactccggaggccacccgggagatcctcgatcgcgaaatcctcggcatcgccgaggccatccgcggctcggggctgtccgccggcatcatcgacgccggcttgtcacgcggactggccggggtgtccggcagcacgctggtggtcaacctggccggctcccgctatgcggtgcgcgacggcatggcgacgctgaatccgttggcggcccagatcattgggcagttgtcgagcctggagatctagacccgggctgcccggcgccggtcgttacgactcggcctccgcgcgcggcccgtactcgggtgggggcgtggtgctcacgcttccgtgcttgcccgacgagtcgccgttggtctgcgcgagcagatcgcggatctcggtgagcagaaccacctgggcgtcgtcggccggctcgacctcaccccgcttgcgcagcgtcgtgtagggcaacacgaccaggaagtacaccaccgcggcgatgatcacgaagttgatcgcggcggacagcacgttgttcaggtcgatggtctgcccgccgccgatgctgatccgcaggatgccgatgtcggacttctggttgacgccgatgcggttgatcaacggcttgatgatgctgtcggtgaatgtcgtgaccaatgcggtgaacgcggtaccgatgaccaccgctgtggacaggtcgatgatgttgccccgcgagagaaactccttgaaccctttgagcattggcgatggcctttctgggactggacagagtttgctgtcggccaggtgatcccccgcggacaggcgctcagtgcagggtgagtgtcaccgtctggccgagcgccgcgcctgccaccgtgttcgccaccccagccggtagcgcaaccaacactacgcggtcggcaccggcggcctgaatcttttcccgggccgacaccagcaccacgacggcgtcggtggccagcaccttgggcgcggcgtgggtcgtctccgccgaggtgttggccggcgcggccagcacgtcgaccacgtccccgggccgcaccaggtcgatcagcgcgccgtccgccgggtgcagcggcacgatgcgcgcgcccgctgccgccttggacccgacggccgcctcggccagtcgactgcccagcagtcgcacgtcggtgagcacctcgccgcgtcgcgccgggccggccagtgtggaacccagcaccgcgccgatctcggcgggtgatccctcgggaaccgttgcggccaaacgcttttcgagacggacatcggcggcggtcaacgcggcgcccgggcgtaggtcgtgctcggccaccactaccggcgcatagtcaccggcgggatcggaccgcagcgcggcgatcgcggccaacaccaccagggcgccggccgcgatccggcgggccagtacggtgcgcgtccagtccggccgcagccacaccggcagccggctcaatacgcttgggttcagcgaggattcgcccacgccgcaacggtaggcgcggcgcggcgcccgggtcagcgctcggcggcgccgctgtggataaccgtcagccggccgcggcggcggccggcgcggggctgctgacggccttctcgcccgagccggacttggcgctcgagccggagctgtcgctcgtcgacgagctcgagtcgctcgaggaggagccgttggtcgaccccgcgggcttcttgccggactcccggctatcggtgcggtagaagccgctgcccttgaacaccacgccgacggagttgaagcgcttgcgcagccgcccggagcagtgcttgcacgtggtcagagcgtcgtcggtgaaggcctgcacgatgtcgaagcgatcgtcgcactcggtgcactgatagctgtaagtcggcacgtaaacctccggatggtcgcaaaccttgttagcactctagcgtgtcaagtgctagaaccgccaggtgacgcgtctcattcccgagatgaccgagacgaccgagacgaccgagacgtcagcgggcgccgagggtgacccacccgcgctgcggcgtcagcgcgtgggtcatcgggacgtcgtgcggctcggccggtagctcgtcgagcagttccgcgtcgcgcaccagcgcgaccagccgcgcccgcggatcgcggtcgcccagcgagcggtcgtagaacccccggccccggcccaggcgcaccccgcggcggtccacggccagcgccggcaccagcaccagggccgcgtcggccagcgccgatgcgggcagccacggctgcgccggctcgagcagcccccaccgcccggtggtcagggtgccgggccggtattcgccccagcacagcggcagcggggtgttgtcggcggcggtgcgggcgaccggcagcagcacccgcccggcccgccgcagcaacatgtccagcatctcgacggagcccggctcggcgcccaccggcacgtaggcgcacacggtgctgccgctggtcaccatgaactccagctgttcgcgcagcatccgcgcctcagcggcgcgaacgtcgtcggcaacgcggcgccgggcggcgagcagccgttcgcgcagggcggccttgccggtggtggccatgggtaaaccatgacagcccggtcttcgcctgcgccacatccactcggcaaagtcgatgcgggttatcgtgtgaacgatgtcatgcccaaacgtggtggtgccacgcacggcgattgtgcccgccgccggccttggtacccgattcctgcccgcgaccaagacggtccccaaagagctgctgcccgtggtcgatacccccgggatcgagctcgtcgccgccgaggcggccgaggccggcgccgaacgcctggtgatcgtcacctcggagggcaaggacggtgtcgtcgcgcacttcgtcgaggacctggtgctcgagagcacgctggaggagcgcggcaaaaccgcgatgctggacaaggttcggcgggcgccgcggctgatcaaggtcgagtcggtggtgcagagcgagccgctgggcctgggccacgcgatcgggtgtgtggaaccgcggctggccgacgacgaggacgcggtcgcggtgctgctgcccgacgacctggtgttgccgaccggtgtgctggggaccatgtcgaaggtgcgggcgcactacggcggcacggtgttgtgcgccatcgaggtgacgcccgaggagatcagtgcctacggcgtcttcgacgtcgagccggtgcccgacgacgatccggacgtgctgcgggtcaagggcatggtcgagaagccgaaggccgaggacgcgccgtcgatgttcgccgcggcgggccgctacgtgctcgaccgcgccatcttcgacgcgttgcgccgcatcgaccgcggcgccggcggcgaggtccagctgaccgacgggatcgcgctgctgatctccgagggccacccggtgcacgtggtcgtgcaccgcggatctcgacacgacttgggaaatcctggcggctacctcaaggctgcggttgactttgcattggaccgtgacgactacggcccggatttgcggcagtggttggtggcgcggttaggcctgtccgagcagtaaccgggccggcaggcgacggcgggtcggcgcaacgccaagcggtcccgggcggggatgccccgcccgcgcagtgggcgggtcgtgcgccacgcggcgcccgccggatttgagggcagagaggcgcgctgtgcgttcggtggaagagcagcaggcccggatcacggctgccgcggtggcgccgcggccgatacgtgtggcgatcgccgaggcgcaggggctgatgtgcgccgaggaagtggtcaccgaacgcccgatgcccggtttcgatcaggccgcgatcgacggctacgcggtgcgcagcgtcgacgtgctcggcgtcggcgaggtgggcgccgagggcctgcccgcgccgctcgacgactcggtcgacgacgcgcgcgacgggctggtgctgccggtgatgggaaccgtcgaggcagggtcgcgcacccccagtcggttgcagccgcggcaggccgtccgggtgcaaaccggcgccccgctgcccacgctggccgacgcggtgctgccgctggggtggaccgacggcgggactcagcgggtgcggatctaccggggcgcgccctcgggcgcctacgtgcgccgagccggcgacgacgtccagcccggcgacgtcgcggtgcgcgccggagcggtgatcggggcggcccaggtcgggctgctggccgcggtcggccgcgagcgggtgctggtgcatccgcggccgcgggtgacgatcatggcgctgggcggagaactggtcgacatctcgcgcaccccgggaaacgggcaggtctacgacgtcaactcctatgcgctggcggcggcggcccgcgacgccggggcggaggtcaaccggatcgggatcgtcggcggcggccccagggaactgcgcgacatcgtcgagggccagatcaaccgcgccgaggtgatcgtgatcgccggcgcggtcggtggcgccgcggccgaagcggtgcgccaggtgctgtccgagctcggggagatcgaggtggtccgggtcgccatgcacccgggctccatccagggttttgggcagctgggccgcgagggtgttccgaccttcctgttgcccgccaatccggtgagcgcgctggtggtgttcgaggtgatggtccgcccgctgatccggttgtcgctgggcaagcgccagccgatgcgccgcatcgtgcaggcccgcacgctgtcgcccatcacgtcggtggccgggcgcaagggctatctgcgcgggcagctgatgcgcgatcaggacagcggcgagtatctggtgcaggcgctgggcggcgccccgggcgcgtcgtcgcacctgctggccactctcgccgaagccaactgcctggtggtggtgcccagcggggccgagcagatccgcaccggcgagatcgtcgacgtcgccttcttggctcagcgcggctgagcggaacgactgcacacatcgtgaacctgttgcgcaacaattcccgtcatcccggttggccgatgagtgtcggtccgctgcgggtgccggccggggtggtccggttgcgggcggtccggctgcgcgacggcgcgcagtggagccggatccggctggccgatcgggcgcatctggaaccgtgggagcccagcgccgagggcgattggacgacccggcacgcggtggccgcctggccggcgctgtgctcgggcctgcgcgccgaggcgcgccagggccggatgctgccctacgtcatcgagctcgatgggtgcttctgcggccagctgaccatcggcaacgtcactcacggggcgttgcggtcggcgtggatcggctactgggtaccgcgctcggccaccggcggcggggtggccaccgcggccctggcgctgggtctcgaccactgcttcggcccggtcatgttgcatcgggtggaggccaccgtgcgtccggagaacgccgcgagccgggccgtgctggcgaaagtcgggttccgccaggagggcctattgcagcgctacctcgaggtggacaaggcctggcgggaccatctgttgatggcgatcacggtcgaggaggtcagcggatcggtggcgtcgacgctggtccgggccggtaacgcgagctgggtgtgacggccgtggcctagtagggcggcgttgcggcgacgcgccggcggcggccgaaacgttgcccatctgggactagcgcgacacgagtgactagtggtgcttgtgagaggcaaattacaggtgtgtaattgtcctggtcatcacgacccggccgcgttggccaccgatgggcttcgcgggggatgggaaccgaagagagcaggtcatcatgccaagcatcccgcagtcgttgttgtggatatcgctcgtggtgctgtggctgttcgtcttggtgccgatgctggtcagcaaacgcgacgcggtgcgccgcaccagcgatgtggcgctggcgacccgagtcctcaacggcggggccaactctcggctggtcaagcgcggcgggccggccgccgggcaccgcagcgatccccactggacgcgaccggaagactccgacgccgacctcgacgaggagcacgacgtcgccgcggacgagcccggtgaccaggatgacgacgccgacaccgacgagctgagccgccggcggccggtggtgatgaggatggccaccgccgaacccgccgagcccgactatctggacgtcgacgtggtcgaggattccgccgcacttccggtgggcgcccgcggttccgcggccgagaacaacgacgagcagccggccgaggacgacgacgtcgacaccgaggcggtcgccaagggcggcgacgagcaggacagctacgagtacgtcgacgactcgtccggcctggaggagcctgccgccgagggcgacgaggccgacgaggaggcgccggcgccgatgccgcgcaacgcctcgcggcggcgccggttcgacaccaagaccgccatcgccatcagcgcccgcaaatacgccttccgcaagcgggtgctgatggcgatggcggtcgtgttggtcggctcggccaccgcggcgttcaagatctcgccgacggcgtggtgggtctgcggcgccgcgaccaccgtgaccctgctctacctgggctatctgcgccgccagacgcgcatcgaggagaaggtgcgccggcgccgcatgcagcggatggcgcgggcgcggctcggcgtcgagaacgcctatgcccgtgagtacgacgtggtgccgtcgcggctgcggcgcccgggcgcggtggtgctcgagatcgacgacgaggacccgatcttcgagcacctggagtacgcgatgccgatgcggacgttcggttggcccagggacttgccgcgcgccgtcggcgaatagtgctcgcggtttcggcagttgctgccgcggctggtagcctgcttagcgatcaggggctatggcgcagttggtagcgcgactcgttcgcatcgagtaggtcaggggttcgaatccccttagctccacagagtttgagcagctagagggtagttccggagatagccgagggcggcttccgacctctgggtccgcagtcggcacgcagcagatcgaattgccgcatctgattgtcggccacgggacctaagtccaaatggacgggttgcgtgggcagcaaaatgaagagggctgtgtattgcgtaattcgtaggccgggcgtcgcctgcgaaagtgggcggcatgcctgcgcaagcatgggtaacgctgatcgtcggcggcgtcgccacgattggcgtccttgtcacatggcagcaaaagagccgcgccgaccggcgcagcgagtggtggcgacgcaccatgtgggcgtttgagcgcactttcagcgatgacgacacccaggccgagttgggctggaaaatgctctccgccctggtggtctctagactggcgactgtcgatgattccgaaatcgtgcagatgattgccgaacatgcagctctaagcgggccggaggatggcgatggcgacccgggacgataacccccaaaaggtggagcagcggagcctcgcggtgcgaaaggctgccgccaaggcggccgtcgcggccagcgaaaagaccgggcgtccggtggatccacgggtaaagaagctcgccgaaaatcgctgacccacgtgatttgggcggccaggtcccgcttggccggcaggcagtagcggtagttgcggataagaggttcgaatcccctgagctccaacgcgtttgggcccagtcaggcgtcagtcgcgaggcccgctcgccgcgatgagaccatagccggatgaccacccacacctgcacgggttgcgggctcgaaacccgctactcgtatgggcgcacctgcctgggatgcggccaacagacccgccgcccatacggcagctggccggaccgtcatccacgggccgcggtagcattcgcggcgccggcgaggatcgtctacttgggcgagcggaatccgacggccgcgatggcgttgggggtgccgggcacgctcatcgcgttggccgcggtcgcggcgtacccgttcgtgttcgtgcccgcgctgattctgctgagcgtggccttgttggcgtcagcccgctacctggaaacccacagctcgtcgaggtagatcgcacgagccgaccagccttcccgacaaccaggcccggccggaccgcgacaccaatatttcagagcatatgctctgttatcctgtcgaagtgccccgcccccgagtgctggatttcgaccacctgatggatgtggccgagcaactcgccgcggaatccgggccgccggcggtcaccattcgtgccctctcggaggcgacggccatctccaacggcgcgatctaccatgcgttcgggtctcgcggcggactgcttggtcacgtgtggctacgcgctggaaagcgttacctgagcttccagcgagccgccgtggcaaaggcgctgtcgcgcggcgtttctggcgaagcagcggtcgatgcggtggtcgccgccgcggagtgtcccgcgacgttctcgcacgagcacccggcctccgcccggttcctgctccgcgtgcgccgcgacgaactcctcggcgccgccgacgtcccggccgagctggccgacgagttgcgccgactcgacgacgacctcgcgcacctatttatcgaactggccgaaaaggtttggggcagaagggatcaacaggcggtgggggccattcgcacctgtgttgtcgagttgcccaccgccctgctgatcgatgcccacgccctgcacgacgcggcggcgctgcaacgactcgccgccgcggtacgcgcggtgctggccctcacaccacccaccacttccaccaaaccgaaaccgcgcccgactctaacgaaaggggcaccccgatgacatccaagaccggctcagcgccgatcagcaccaacctcaagatctggaacatgctgcagcgcttgccgtttggcaatcgaatcttcagccaggcggtatgcttcaaggcgccctacttcagcacggtccatccggtcatcgtcgaattgcggccgggactctgccgcgccaaggcccccaaccggcgcggcgtgcacaaccacctcggctcgttccatgccatcgcatcgtgcaacatggccgaactcgtcgccggcgtgatgacggaggtgaccgtgccgcccacccaccgctggatccccgccggcatgaccgtcgaatacaaggcccaagcccgcaccgcggtgaccgcgaccgcacgcctggacgccatccccgagttcaccgacgagccattcgaattggtcgtgcccgtcgacgtgtcggatgccgagggcaatgtcttcgtcaccgcccgcatcaccatgcacgtgtcaccgcgaccacgctgacgaaaagctcaccgactgattgcgtgcgcgcgcaccgccggcgcgacccagtcctgcaggaaccgtcgcagctccgcgccggtgcgcggagggcgccccggatcgacgatcagtgactgcagtgtgcgcagcatgacctcgaccagttcgtcgagcccggtgccggcgaatcctgctgcgccccaatcgacttcaaatcgctgcaagatcgacctgccgaacgagatggcgatgtcggaggtgaccccggcggtgaaagcgctggccttgccgggctggaacaccaggctcaggtacctgtcgtgcgcgagctgctcgaaggtgtaggcgatgccctccaccaccgccccggtgggatcggtgatcgaacccaggtgggccgcaaggcgatccagaaacccctccaccgcggacagcgccgtcgcacccagcagcgcctcgtgggtggggaagtaccggtagatcgtctgccgcgtcacgcccagcgtcgacgccacctgcgagacgctcaccgtgccgcgttcgtcgatggcgcgtcgcgtcgcggtcaggatgcgcgcaaccgcctcctcgtcgtcggccgggatgtcacccgaccagccgtgccggcgcattgcgtgatcgtcgcacacaccgggccgcggccttgacaatacaaacggtgatgattgtatggtctgggaggttgacggcgaaggagaagcgagtggcccccatcaacagcccggtgagcggcaccgacgaggcgttgacgcggcgggggctgcgtcacgccctggacaagacgaccgacctggccgagcgggaactgcgggtgccgctgcactactaccgcgaccccaagatcaccgagatcgaggaggcgcagatcctgcgtcgggtcccgctggccatcgtcccgtcggcgcagctaccgaacaccaacgactacgtggtgcgctcggtgctgggcgattccctgctggtgacccgcgaccgttccggggccagtcacgtcctgctcaactactgccggcaccggggcgcgatgccggcctgcggctcgggcaacaccgcgcggttcgtgtgcccgtaccacgcctggacgtacaagaacaccggcgaactgttctcggtgcccggcaaggccggcttcgactcgatgaacaccaaggactacggcctggtggagctgccctccgaggagcggcacggcttcatctgggcggtgctgaccgccgacgcgaccatcgacctcgacgcgcacctgggcgacttcggagccgaactggcgctgtggaattactcctcctacggctatcacacccagcgcgaattcacctccgaggtgtcctggaagggcgccctggaggcattcgccgagggctaccacttcccgtacgtccacgggcagagcctgatcgggcagaacaccctggccaacaccatggtctacgacgagttcggcaagcatcaccggatcggcttcccgttcacctggatcaccaacgccgccaccgaccctgcggcgtcgctggaaccgctggccaacatgggcgtgatctattgggtgtatccgaacctcatcctggccaacagcccggtcgggctggagatcatcgacatgctgcccgccggtgcgccgacacgctgcacggtgcggcacagctggatggcccgcgtccccgccgccgacgacgagatgcgcgcggcctacgacgcggtcttcgaaggcgtgcacgccgcggtgcgcgacgaggacttcgccatgctgccccagtgcggcgagggcgtccggcacggccagcacgaccacatgatcattgggcgcaacgaaatcgccgtccagcacatgatcagggtgttcgcccacgagctgggggtggcactggcctgagtcgaggcggttggagtggccgcaggccggcgcgggtacagatgctctgaacctgatcgagaggatccgatggcgcaccgcgaccgcgactcgaccgacgagctgctgcaagaactgctgtggacctacgggccgtgcgggcaggaggacgcggtgcgcgccgtcatcgcccgcgaattggaacccgtcgtcgacgacctgtggaccgacgacgccggcaacctgatcggctacgtcgccgccgacgcatcgcggggcgatgccggggcgcccgaccaccggcaccggaccgcggcgatccccggcaccgccacccgggtcatggcccacatggacgagctgtccatgatcgtcaaacgggtagaacccgatggcacactgcatttgacgcagctgggcaccatgtacccgggcaacttcgggctgggtccggtcgccgtgctcggcgacaacgaaaccctcaccgcggtactgactctcggctccgaacacaccaccaaggaaagctcacgaatctgggagaccaagcccgatcagggtgaccgatcgctggactggcatcacgtctacgtcttcaccggccgcagcaccgacgaattggccgccgcgggagtgcacgccggcacccgggtgtgcgtggaccgcagcaagagatcggtggtcgagatcggcgactacgtcggcgcctacttcctcgatgaccgcgccgcagtgaccgcgctgctcaacgccgcccggatgctgcgcgaacgcggacaacgccccgccgacgacgtgtacctggtgttcaccgccaacgaagagatcggcggggtgggcggcgcctacgccagcgccaccctgcccggcgacctgaccctcgcgctggaagtcggccccaccgaacgcgaatacaccaccagcgtcgccggcggcccgatcgtcggttacagcgacgcgctgtgcgtctacgacaaaagcgtcgccgaccggctgctgaaaatcgccaccgaccgcggactgacgccgcagccggcggcgctgggcgccttcgaatccgacgcgtcgcacgccaaggcaagcgggctgaccgcccgcgccggcctgctgtgcctgcccacgctgagcacccacggctacgaggtggtcgcgcgcagcgcgatcgacgacatggccgccatcgtggtcgatttcgtactgcagccgggccggccgaacggctgacgcggagtcggccaaaacacctcaaccccgctggtcaccctgttagtctggcgacgcttccggacgcagaacgatggggttggcatgtggcacacgtgggctcgcggctgagcgaatcactcgaaagacaatccccatgacacgcccacgaattcgggcacgagcgccgctgcggatctcgttcgccgggggcggcaccgacgtcccgccattcccgacgaccgagggcggctgcgtgctgtcggcgaccatcgaccgctacgcgcagggatcgctggcgccgcgcaccgaccgccgggtctccatcgagtcggtggacttcaagaccacgcacgagatgacgctcgacagcgagatcctctacgacggcagcctggacctgatcaaggccgcggtgcgcaggttcggccgcgacggcacggacggctacgacctggtgctgcgatccagcgcgccgcccggctcggggctgggctcgtcgtcgaccatgatggtcgcgctcaccggcctgctcgccgagcactaccgggtgccgatgggcgaatacgagaccgcccagttggcgtgcgcgatcgaacgcgaggacctcggcatcgccggcggcatgcaggacatgtacgccgcgacgttcggcgggttcaacttcattgagttcaccgaccgggtgatcgtcaatccgctgcggatccgtgacgagaccgccttcgaactcgagctcagcctgctgctgtgctacaccggcatcacccgcgactccgcgcgcgtgatcgaggaccaaacccgccgcgccacaacgggttcggacgacacgctggccgggctgcgggcacagaaggagttggcggtcgcgatgaaggcggccctgctgaccggcaagctgaacgacttcggtgcgctgctgggcgaagcgtggaccgagaagaaacgaatgtcgccctacatcaccaatgagcgcatcgacgacctctacgagctggccctgaaaaacggtgcgctgggcggcaagctgaccggcgccggcggcgggggatacatcctgctgttctgtgacttcgccaaaaagcaccggctcatcgaggcgctggaaggcgccggggccgccgtcaccgaattcgccttcgagagcaagggattgacgacatggcaggcatgacggggcccgatgtggtgccgccgagcgtggagttggtgcagcggcgactggccgagacgatcgcggtcaagcagcagatgcagaacggcgtcgtcgccgcccaggccgtcgaggtggcgcgcgcgatgatcgactgcctgcgggccggcggaaaggtgatcctgttcggcaacggcggatccgcgcaggacgccggacatctggccgcagaactcatgggccgcttcgcttttgaccgcccgggcctggcggccatgagccttcccgacgccaccgcggcgatcaccgcgatcggtaacgactactcgtacgacgaggtgttcgcccgccaggtgctggccgccgggcgggccggggacgtggtggtcgggctgaccacatcgggcaactccgccaacgtcgttcgcgcgctcgaggccgcccgccaggccgggatgacgaccgtcaccctcaccggtgcgggcggcggcaaggtggccgacgtcgcgcagatctgcatccgaattcccagcgacgacaccggccggatccaggaagcgagcctgcacctggggcattcgatttgcgaaatggtcgaagcggcactgtttccccggccgtcctgaccgcgacgatgcccgcacccgagctgcgcgacgtccgcacggtcttcctggaccgcgacggcaccgtcaacgtcaaggccgccgagggcgagtacatcaagtcgccggccgagctggtgctgttgcccggtgcggcccgggcgctggccgcgctgaacgctgcgggcctgcggaccgtgttggtcaccaatcagcgctggctctccgagccgacggcggcgccggccgatttcgccgccgtacacgaccggctggtacgactgctcgccgaccggggcgcgcgcatcgatgccgcttaccactgcccccaccccgcgaacagctgcgactgccgcaaacccggccccggcatgctgttgcgcgcggcggccgagcacgacgtggatttggccgcttccgtcatgatcggcgacagcgacgtcgacatggtggcgggccgcgcggccggaacgaagacgattctgatccgccccggcgcccggcaggccgtcgcagaggccgatttcgtggtcgacgacctggccgcggccgtcgaactcatcctgaatgccggaaaaaccccgcctgccgggtgatcggcgctgcctgcttgccgcggtcgtgacctgctcataaccttggcaacatccgagcgcgtcggggagcgtggggcctggcgcaaccgacaaatggcgggcaggtcatggcatcaccgcgacaggcagaccggtgccgtgctgccgcgggtggcggtccctgacggtggccggactgaccggcgcccgggccgacgagctggcgacgatggacatcttcgcgggatgtcccgccgaagatctcgccccgttggcgcgccggctgcggccgttgcgcgccccggccggccaggtgctgatgcgccagggggagcaggctgtcgagttcctgctgatctcctcgggcagcgccgaggtcaaacacgtcggcgacgacggcgtggtgatcaccgagcacacgtcccccggcatgatcgtcggcgaaatcgccctgctgcgcgacattccgcgcaccgccacggtgaccaccgcccaaccgctgaccggctggaccggcgacaccgaggccttcgccagcatggtgcacatccccggcgtcatgccgcggctgctgcgcaccgtgcggcagcgcctggcggcgttcatcacgccgatcccgatccaggtccgcgacggcacgcacctgctgctgcgcccggtgctgcccggcgacagcgagcgcaccgtgcacggccacatccacttctccagcgacacgctgtaccggcggttcatgagcccgcgactgcccaccccggcgttgatgcactacctgtcggaggtcgactacgtcgatcacttcgtgtgggtggtcaccgacggcgccgacccggtggccgacgcccgcttcgtgcgcgacgagaacgatccgaccgtcgccgagatcgccttcaccgtcgccgacgcctaccagggccgcggcatcggcaccttcttgatcagcgccctgtcgatcgccgccgaggtcgacggcatcgaaaggttctccgcgcgaatgctttccgacaacgtgccgatgcgcgcgatcatggaccgctacggcgcggtgtggcagcgcgaggacatcggcgtcatcacgaccgtcatcgatgtgccgcaccggcgcgacctgccgttccgcaagcacgaggccgacgagatccggcgggtcgcgcggcaggtgatcgagaccgtcggctgagccgccggcgtggtgcgcgagcacgccctgtctgccgaccatgaggtgacgttcgaatccgctagcgcctgcggtagcgcgttcgaaagtgacgtcgtgcttgcactcgggtgacggcaggcccagactttggcgtggcagggctggatatggcggcgtcctgtgctatcaactcctgatgcggccgttcgggattggcccggcggtgaccaccgtgctcacgctgatggtcgccgggtgcgctcacccgcccccgcccaaaccgtcggccgcaccggcacaatcgccgccgagcaacacggccgccgtcaaccccgccaacatcaagcgggtggtccgcgacctgccgccgggctacgaggtgacgacgggaattcccgtcgccgccgcaccgaaggtgatctggggcctggccgccgacgcgcgggccaagccgccccgatgcgccgtcctggccgaccccggcaacggacgcgaccagtcggcgcagggcgtgtcggggtcgggcagcggcgggatcgtagacgcggtggtggtggctttgccggagcccgtggactttccgcgggatctgctcggcgcgtgccagcagtggtccgagaccgccgggcacaccaccgtccgcgtccgcctcaccgacggctcacacatcgacggcgtcgaaaccctgggcatggtggccgacatcacctcatcggtcgaatcgggcaccgaaatcgattcgcgcagctacacattcatcgcctatctgggcgactactacgccttcaccaccctgaccaccgatcccggcgcggcggttccggtgctgccaccgcagttcgccgcggatctgctcgccaaaacggtgtccacgttgcgcagttgagccacccgcttgggtagattggccacgatgtccaagctgttgcgcgcggtggccgctgtctgcgtcctggccggctgctcatcggccactcacccggcgaaggtggacatcgccaaggtcgccgacgtgaaacccagcttcggacccgactacaaggtcagcgacaccggcgaacgcggcatcgaccccaagctgctggccggccgcaagctgcccgacggcctgaccttcgaccccgcccagtgcgcgaaagtggcgagcgggccggatctgccggccgatctgcagggcaacatggccgcggtgaccgccgagggccgcggcaaccgcttcgtggtgatcgcgctcgagacctcaaaagccttgccgttcaacgaccccgggaaggactgcgccaaagtcaccttctccggtgcgcaactgcgcggcggtgtgcaagtggtcgacgcgccgcagatcgacagcgcgcgcacgctgggcgtgcaccgggtgctgcaggcgctgacacccggcggcccgcgcaccggcgaactgtacgactactccgcgcaattcggcgactaccaggtgatcgtcatcgccaacccgctggtgatcccgaaccagcccgttgctcccgtcgacacccaacgcgcgcgcgacctgctcgtcaaagcggtggcatcggtgcgtgctcaatagtcagcgcacgccgcgcgggcggaattggatgctcacccgcggcccgaccggcgccgtcgtcttgggcacggcatgctcccaggtgcgctggcacgagccgcctatcaccagcaggtccccgtgcgcctgcggcagccgcagcgacgggccgccgccgcggcgccgcagcgcgaacgcgcgggtggcgcccaggctgacgatcgccaccatggtgtcctcggaactgctgcggccgatggtgtcgccatgccaggccacgctgtccgagccgtcccgataacagcacagccccaccgtggtgaacggctcgccgagttcgccggcgtagatgtcgttgagccggcggcgcagccgggacagcatcggatgcggcggctcgtcgaccgtgaggtcgtgaaagctcaccagccgcggcacgtcgaccacccggtcgtacatctgccggcgttcctcccgccacggcaccgtcgacagcagggcatcgagcagatcatcggcgtcggtgagccagccggcgcggatttcgatgaaggcgccgtcgccgagctgccggcgctcggtgtgctggaacagggagccttgaaccgcgatctccacgcgacccagtttatcgcacatccgttcgatcccgaggccgcggcggcgggcgtgtgacggcccatgccgccctccgcgccgctacggttgaacctgtgggcgtggttgagctgggcaccaattccgaggtgggcgcgctgcgggtggtcatcctgcaccgcccgggcggcgagctgctgcggctcaacccgcgcaatgtggaccagctgctcttcgacggcctgccgtgggtggcccgcgcacaagaagagcacgaccagttcgccgagctgttgcgctcgcgcggggtcgaggtgctgttgctgtcggatctgctcaccgaggcgctgacgcacagcggggccgcgcgaatgcagggggtcgccgcagcggtcgatgcgcgacggctgggagttcctctggcgcaagagctttcggcctaccttcgcgggctggagccggcccggctggcccaggtgttgatggcggggatgacgttcaacgagttgcctgccgatacgcgcaccgacgtgtcgctggtgctgcgcatgcaccacggcggcgacttcgtcatcgacccgctgcccaatttggtgttcacccgcgactcgtcgatctggatcggcccccgggtggtgattccgacgctggcgctgcgggcccgggtccgcgaggcctcgttgaccgatctcatctatgcccatcacccgcggttcaccggggtgcggcgggcctacgaatcgcgcaccgccccgattgagggcggcgacgtgctgctgctggcgccgggcgtggtcgcggtcggggtgggggagcggaccacgccggccggtgcggaagcgttggcccgcagcctgttcgacgacgatctggcgcacaccgtgctggccgtgccgatcgcccagcggcgcgcgcagatgcacctggacacggtgtgcacgatggtcgacaccgacaccgtggtgatgtacgccaacgtcgtcgacgcgctctcggcgttcaccatccagcgcaccccgtccggcgttgagatcagcgaggcccccttcttggaggccgcggccacggcgatgggaatcgacaaactgcgagtgatcgacaccgggctggatcccgtcatcgccgaacgcgagcagtgggacgacggcaacaacacgctggcgctgtcacccggcgtcgtcgtcgcctatgagcgcaacgcgcaaaccaacatgcgcctgcaggaggccggcatcgaggtgttgacgatcgcgggatcggagttgggcaccggtcgcggcggcccccgctgcatgtcgtgcccggtcgcccgcgacccgctgtgacggcaccgcgaaagtgcaactggcaacgcgtttcccgagtggcgccgtcggtagttgcactctcgcggcaaggcgcagaagctaacgccagctgggcagccagatctccatgttccaggtttgctgcgagatcggcagaccggtgagcaccgggaacagccaggcgaagttggtcaccaccaacgccacgtagcagcagaccgcgatcagccccagggtgcgccgctcggagttcgcccgcagcacgcccgtagcggtgggcgcgtaaaggatgtcgccgcagatcagggcgatggccatggccaggaacggcgccatcgtggccgcgtagaagaaatacatctgccggtcgatgtcggcgaaccagggcagccagcccgcgcaatacccgaccagcaccgcggcgtagcgccagtcgcggcgaaccagcatgcgccagagcgcgaaaaccagcaccggcaccgccagccaccacatcgctggggtgcccaccagcatctcggccttgacgcacgattgcgcgccgcagcccgggacgttctgctcgtcgatggcatacagcaccggccgcaacgacatcggccagctccacggtttggattcccatgggtggtaattgccggcggagttcgtcaagccggcgtgaaactgaaaagccttggcagtgtagtgccagagcgatcggatggcgtcgggcagcggcagcaccgaacgcgggccgatggtctggcccacctcgtgccgatcgatggccgtctcggaggcgaaccagggcgcatagccggccagatacaccgcggccgggatgaaccccagcgcgtacccggtgggcagcagatcccgccggaccacccccagccagggccgggtcacctggtactgacgccgggcggcgacgtcgaaagccagcgacatcgccgcgaagaacagcacgaagtacaggcccgaccactttgtcccgcaagccaatccgagcagcacgccggcgccgaaccgccaccaccgcacgcccagccgcggaccccacaccgtgtcggcgctgcggccctgcagcagcgcggtgtgcaggcgttgtcgcacctggtcgcggtcgacgatcagcgccccgaacgccgcgaccacgaagaaggtgaggatgccgtccagcagcgcggtccgcgacgccacgaagctgacgccgtcgcagatgaccagcacccccgcgatggcaccgaccagtgtggagcggctgattcgccgcacgatccgcaccaccagcgccaccatgaccacgccgagcagcgcgccggtgaaccgccagccgacgccgttgtagccgaagagcgcctcgccgatcgcgatcagttgcttgccgaccggcgggtggaccaccaggctgaaccccgggttgtcctccaccccgtggttgtgcagcacctgccaggcctgcggggcgtagtgcttttcgtcgaaaaccggtgtgccgccgtcggtgggcgagcccaggttcacgaaccgggtcaccgccgccaccagcgtcaccacgccggtcaccacccagccgcgcacgtcatcggtgggcccgaaatcggccgcgggaaccaacgggcccgggctgacgacgggcaccacgcgttcggtctcggcgccgtcggtgtgcacgggggattcgcggggcggggcggacatcggtgtcgatcgtaggctgtcggtcatgaccaccgggcgcctgttgctgggggcaacgccgttggggcagccctcggacgcctcgccccggctgctggatgccctggcccgcgccgacgtggtggccgccgaggacactcggcgggtgcgcaccctggccaaagcgctcgatgtcgccatcaccggccgggtgatcagcatgttcgaccgggtcgaggccgccagggtggactcgctgctcgaggcgatccggtcgggggcgacggtgctggtggtcagcgacgccgggatgccggtgatcagcgaccccggcttccggctggtgacggcctgtgtgcaggcggggctgccggtgggatgcctgcccgggccctcggcggtgatgacggcgctggccgtgtccggactgccggcggagaagttctgcttcgagggcttcgcgccgcgcaagaaggcggcgcggcgcggctggctggactcgctggccgacgagcggcgcacctgcgtgttcttcgaatcaccgcgccggctgccggcctgcctgcaggacgcggtggagcggctcggcggtgagcggcgggccgcgatctgccgggagctgaccaaggtgcacgaagaggtggtgcgcggcacgctggacgagctggcggcctgggcgggcgacggtgtgctcggcgagatcaccgtggtgctggccggcgccaccccgcgcaccgacctgccgtcgctggtcgccgaggtcgagcagcgggtggcggatggcgcccggatcaaggacgcctgcggcgaggtggccgccgcccaacccggcgtgcggtcccgtcagctctacgacgcggtgctcaaggcccgccgcgactagcccgccgagctcgccgccgcgatggacggcagcccgacgatgggcgaggccttgtgcaggcattcggcccactcggcgtcgggatcggagtccgcggtgattccgccgcccacgcccagcaccgcgccgcccgcggcgtcgaattcgacggtgcggatcgcgacgttcagttcacatccggccacgggtgaagcccaaccgattgtgccgcaatatattccgcgagtagcgggttcccatttcgaaagtagttggcgggcacggtgtttgggtgtcccggtgaccgaggcgggcgggaacgcggcgtccagcagggccgacgtcggcagctcggtggggacctgcgccgacaccgtcgacaccaggtgccacacccccggcgcccggcgcaccaccagcagctccggcacgctcaccgtgcccaccgtcgccacccggcccaggtcgttgcgcaccaggtcgacgatcatgatgttctcggcgacctccttggccgaggcgcgcagcgccgacggccaggcgtccagcggcagggtgcccttgatcgggctggacgtgacgaccgtgccgcggcggcgcaggaagagctccggggacagcgacgccaccgccccccactcgccctggatataggcggcccgcgccgggccggtgcgggcgacgccgtcgacgaagaagtccagcggggcgccgccgaccgtcccgcggaattgcgtgcacacgcacgcctggtacacctcgccggcgcggatggcttccaggcaggccagtaccccgtcgcggtgcgcggcccggtcggcgacgtcccagtcgatccggcacgggcgcggcgggccggcgggcgcggccagcgcgccggcgagccaccgcggcatcggcgcgccggtgaggctctcgtaccaccactgcccgtcgcggtcgcggcgcaggacgcagtccgtccagccgccggcggcctcgggaatccggttcggcttggcgtcggcgccgccgtccggataggacaggtaaccgatccacccgccgcccacatgcggcggctgcggtgtccgcgccgtgccgaccgcgaacacgtcgccggggggcaccggacgcaccggcaggctcggcgcgatcaccgccagggcgtcgaaccagtcgccggtcaacgcggccggcggcggcagaccgagccggcgggtgacatcacccacggcccgcagcacctggggtgcggggccgaggtcgccaagccggtcgatgcgcaccgccctagtttgacagagcggcgcgggttcggggcgagtcagccgcggctgacgtcgcgggcggtggccagcgccgccagcttgtgcgggttgcgcatcacgtagaaattggtgatcttgtccgccgcgatctccaccgtgatgacgccttcgagccggtcgccgaggtagagcaacaccgccggggcgccgttgcaggtcaccgtgtccacccgcagggtggcgtactccgcggccttgcggaacagcccggtgatggcgcgggccactttctcggcgccgaccaccggcctgcgggcggcgctgaccacgccgccgctgtcggcggtccaggtggcgtccggggccagcatcgccatcagcgcctccacgtcgccgctggccgccgtggccaggaactgcgcggtgagctcggcgttgcgcttggggtcgatcgcctgcccggcgccggggtggcgcttgcgccgggcccgcacgtgttcgcgggcccggtgcgcgacctgacgcacggtggacgccggcttgcccaccgcctcggcgatctcgtcgtagtcgaatccgaacacctcacgcagcacgaacaccgcccgctcgtctggactcaacgtttccagcaacaccagcatcgccatcgaaatcgactcggcgagaacgacatcggtggacggatcctgctcgtcgagcagcagcggctcgggcagccagggcccgacgtactcctcgcgccggcgcgcgccggcccgcagcgcgttgagcgcctggcgggtgaccagctgagccaggtaggacttggtgtcgcgcaccgtggccaggtcgacggtcgaccagcgcaggtagctgtcctgcaacacgtcgtcggcctcggtcgccgagcccagcatttcgtaggcgatggtgaacagcagcggccgcagcagggtgaatcggtcggcgtgctcgctgccggtcggtgcccgcgtcatcacaccccgacccgctcgtcggccggcacccgctggccgcccttgagccagcggtacgagccgggcttggcggcctcgcgccggatcgcccacagcgtgccccggcagatcgcctccttgagcttcgcggcggccggcccgcccaggtacgcgttgatcggggtgtcgtcggtgcgcgccagctggaaggtggcggccgcccggcccaggctgatgcactgcccgacgaacgcctggttcagcggcgccggctcggtcccggcgatgcggcccaacacggtgttggcggcctgggcgcccagcggaccggcggcctggcagctcatccgcaacggccgcccggacggcgcggcggcgtcgccggcggcgacgatgcggtcgtcgtcgatgctggtgagcgtctcgtcggtgagcagccggcccagcgggtcggtgcgcagcccgctgcgggcggccaggtccgggacgctgaatccggccgtccacacggtggccgcgctgggcagcaccacgccgtcgctgagcaccacctcattccagcgcacctcggtcacggtgacggacttcagcacgccgaccccgaggcggcgcagccgcttggccaccgagcgccggccccgcgggctcagcgacgggcccagcaccgggccgcagatcagggtcaccgggcgtccgagctcggccagctcggaggcggtctcgatgccggtcagcccgcccccgaccacggtgatcggtgccggcagcggcagatcggccagcgcgtagtgcagccgctgggcgctttccaggtcggccaccgaatgcgcgaactccgcgcagcccggcacctcggccaccgcgccggtgctgccgacggcgtagatcaggtagtcgtagtcgagcccggcgccggaggtcagcacggcccggcgggcggtggcgtcgatgtggtcgaccgtgtcgacgatcagctcgatgccctccccgagcagcgtggcgtaatcggcggtcgccgtgccggtgtccgccaccagctggtgcaaccggatgcgctccacgaagaccggccgcgggttcaccagcgtgatgtcgatgtccgggcgctgacgcagatggttggcggccagcgtgccggcgtatccgccgccgacgacgacgacatgtgttttgctgcgggtcacctcggtcatggctgtctcctgttcgtgaggacgtgtgcccttgagacaccgcagcccgcttccgcgtgacaggttcgcccgcaattgtgaccggcctcactgccgcgggcccggccggccccgctgagctgcggcgacaccgcggccgaacgtgcgtgatacgctgcgctacgccaattcgtggcccgccccgagcggaagacacgcaccagagaaaccccgaaatccggggccacttgcccgcgcatcggtgtgtattgggagaagcaaaccgtgacgacgaccatctcttcgagtggacccggcgcgccgaccggtcgcggcgggtggtcggcggttgtccccgggtgcgatctgacgcgctgacgatggtgtgctcatcggggaaacgagcgctggccgctgtcatctgcatcgcggcggtgctgagcggatgcggcggcaagcccgatccggggccgctgtcggccatggtcagcccggccatcccgcccaccgcgcaggagatccccaacccgctgcgcggccagtacgagcagatgctgaatccgcttttcccgcaaggtaattcggcgcagcaacggtactctccgtggcccgcctcctacgacgccagcctgcgggtctcctggcggcagctgcagcccgtcgacccgcgcacgctgccccccgacgcgcccgacgaccgcaagttcgacttctccgcgatcgacgacgcgctggccaagctgggcgcccgcaacatgcgcctgaccctgggcgtgtacacctaccggtcctgttgcaacgacacctatccggacaacaccgccatcgcgattccggactggctgcgcccgtcgtcgacgagttatccgccgccgaaccaggcccccggcgtcacccaggtggtgccgaacttcaacgaccccgactacctcaacggcgtcaccgcgctgctggccgcgctgggccgccggtacgacggcgacgagcgggtgagcgtgttcgagttctccggctacggcgacttcggtgagaaccagctcggctatccgcgcgattcgctgggcgcgccgggccccgctccggacgacagcgtggcaaagctgggttattacagccaattccgcgaccagagcatcaccaaggcctccatcgcgcagctggtcgcggccaacaccaacgccttcccgcacacccagttggtggtggcgccgcagaatccggagatcgtgcgccaactgctcgccgacgacgtcaccaagaaactgtccgcgccggtcgggatccgcgcggattgcctcggggtgcagtcgccgttgccggaatgggccgaggccaacgactctcactacgtccggtccaacgacgccgtcgtcgcggccatcaagcagcggctcggttcgggactggtgatcagtcagtggtgccggccgcccaagggcgccgactcccggtcgtactacgagaaggggctgcacgacgtcatccgctaccacgtctcgatgacgtcgagcgccgacttcccggaccgggatgcgacgtcggcgatggaccccgagctgtatctgctgtgggggcaggccaatacgtcggctggttaccggtactcggtggaggccaagcccggatcgcagtcgatccagggcaaggtggccagcatctcggtggtgtggaccaactacggcgcggcggccgccaccgagcactgggtgcccggctacaagctggtggacttctccggggcgatcgttcgcagcctgcccgcgacggtcaacctcaagacgctggtgcacgacgaatccagcacgtcacgcgaggaaccggtcccggaatcggccaccgaatcggtgcacgtcgacgtgaccggcctggcgcccggccactacacgctgcgcgccacggtggactggcagcaacacaagccggacgcctcgcacgtcgtcaactacgcgcccatggcactggcccgcgacggccgcgacggtgccggcctgtatccgattgccacacttgacatcccgagcgacgcgggctcggcaagcggtcactgaccgtcgcggctttttccgcagaatcccgatcgccgggccggtgcgtgataccgtttccgcacgtatttcggccccgtgacgtggggtcggcacccagacggaatgtgcgcccgtatcggaggactccgtgccacgcagcctggacctggtggtcacctccgtcgccaccgcgctgatggaggccacggcgtccacggcacgctcggtcagcgaaacggtgctcgcgcagctcgtcgagcagttcgatgtggacgccagcttcctgcaccaccacgacgccgcgggcccggtgccggtggccgagtggccgcggcgaaccgatgccgcgggcccgatggccgcgctgcgatccgaggacgtcgaatcggtgctggcccaatgcgagcggcagcgccggccggtggtgagcagcccggaccgggtcgacggttggctgcgccgctggctgcagcgcgacaaggcagccggcgcgccctcggtggccgccgcaccgctggtgtccggcgacgccaccaccggtgtgctcggcttcgtcaagttcggcgcccgcaggtggaagccggaggagatcaacaccctcgaggcggtcgctgcgctgttcgcgcagctgcaggcccgcatcgccgccgaggaacggcttcgctacctcgccgagcacgacgacctgaccggtgtgtacaaccggcgggcgctggttgcgcatctgaccgaacggctggcggccggaaaccccgggccggtggcggtgttctatctcgacctggaccggttgaagccgatcaacgactacctcggccacaccgcgggagactggttcatccgggtgttcgcgcagcgcatcgaggaatgcgcgggcgagcagagcatgatcgcccggctgggcggcgacgagttcgtggtcatcccgcaccagccgatggcgtccgaggccgccgaggcgttcgcccgccggctgtcgacgctgctgtgcgaccggctgaccatcggtgggcacgtgatcagccggaccgtcagcatcgggctggcggtgggcacacccggggcggacaactgcaccgacctgctgcggcgggccgacgaggcggtgctgaccgccaagcgcgccggcggcaaccagaccgcggtgtccaccgatgacatgtcgctgaagcgggccttccgcaacgacatcgagctgcacctgcagggcgacatcgaaagcgagggcctgctgctgcactacctgcccgaggtcgacctgtggaccggcgccgtcgtgggggccgaggcgctggtgcgctggcggcacccgatctgggggctgctgctgccggactcgttcatcggggtcgccgaatcgaccaacctgggcgccgagctgggcgggggggtgatgcgcagcgcctgcgccgatttcagccggtggcgggccaacggcgtgggccacggcgcgatgttgcgcatcaacgtctcgcccatccagctgatcagccggggcttcgtggaaaccgtcgccgacacgatcggcgagttcggcatcgacgcgggctcggtgtgcctggagatcaccgagcgcgcggtggtgcacgacaccgagaccacccgaaagacgttgtcggagctcaaggaagtcggtgtgcagatcgccatcgacgacttcggcaccggctacgccgtgctgtcccacctgaagtcgcttcccgtcgacatgctcaagatcgacgccgggttcgtccgggaggtgggcaccgacgccggggacctggcgatcgtgcgggccatcatcgggctggccgaggcgttcggcctggaagtggtcgccgagggcgtcgaaacacctgctgccgcactgactttgatgcagcacggctgtcaccgggcgcagggttttctgctgtcgcgcccgatccccggcgaggcgatggaagcgctgctgtccgcgcgctggatgccgatgccgtttctcgccgaccgcgaggcgtcgtcgatgggctcgatctagcccctcgacccgctcagcgttcgtccggcaggaagacgaagttgttcacgtacgggccccggccggtccagccgtcctgccggctgccggcgttggccgggtcctggtgcaccgccgggtcgaactccgcgatcggccgccgcgcgccgtccagctcgaagtagcccgagtagccgagaccggtcagcagtcgggtgatcccggcgacggcgccgcggtggtggcgctcctcggcttccaccacgatcgccggccggttgcgcgcgagcgtctctggggcgccgcgcaataccgccagctcgtggccctcgacgtcgatcttgaccaggccgacgtcatcgagattcaggtcgtcgagccgcttgaccggcacgtcgatgacgcggatctggtccccggtcaaatcgcccaggctgttgtcggtgtcgatggtgctgcggcccggctccgactcgaccacccgcatggcgatcgttcccggttcatccgacagcgccacggcctcgacccggaccgcggccccgaccgcgtcgaacatcgccgccagatcgcgagcctgggccgggcggggctcgaacgcgatcaccgagcgtgacgacgccgccatcgcgatcgtgaactcgccgaggtcggcgccgatgtccagcgaaacccgatgcgggtcgcacaatgacgccaccagctgcacgtccgggcgggaccggccgagccggtccagaatgcggaatttgcgccgccagaaccggcgcggcgcgagcctcttcgccgctggcgcgagccaccgtttggccgagcgtgccagcgccatctgcggtgatctcctgtccgattcccggggagcaccagcttaaatgacgcccggcggcggggcgccgacgacgagctttcggggagccgggcggaatcgggcatgcgccgcgggcgcgggcgctaccctgttgtcacccttggtatcccacgcatgaatacccgcgacggccgccggccgcgagccgccagagaggttgcagccccatgatggagacggcgtttcggcgagcaatgcccgccgatgccgttccgcaaccacggcgagccgtcgccgccgggcgcggatcagcccgcgccacggcggcggcgagaacgaggaagttcgttctggtcgtcggggtgtgcttggcgctgctgctcgacgggtgcggtcagcgcggcgatctcggtccgctttcgctgatcgccagcccggccatcccgttgtcggtgcaggacgttccgaatccgctgcgcggccagtacgaagatctgttgcaaccgcttttcccgcaaggcaatccggcgcagcgtcgctacccggcctggccggcgtcgcaggacgccagtttgcgtgttccgtggcggcagctgcagcccaccgatccgagcagcctgccgcccgacgctcccgacgaccgcaaattcgatttcagcgtgatcgacgacgcgctggcgaagctggccagccgcaacatgcggttgaccctgcgggtggtcgcctacaactcctgttgcgacaccgtctatccgaacaacaccaacatcgcgatgcccgactggatgcgcccggcggccaccaattacaccggtccgcaacggtattggtggtcacccggggtgacgcaggtcgtgccgaactggaacgaccagaactacctcaacgccttcgggcagctgttggccgcgttggggcgccggtacgacggcgacgagcggctcagcgtgttcgagttctccggctacggcgatttcagcgagaaccacatctcgtatctgcgtgactcgttgggcgcgccgggtccggcgcccgacgaaagtgtggcgaaactggggtatttcagccagttccgggaccagaacatcaccgccggttccattcgccagctggtcgaggcgaccgtaaaggcttttccccacacgcaattggtgacgacggcgctcaacccggagatcgtgcgccagttgatcgccgacgacgtcaccaagcggctgtccgccccggtcggcatccgcgccgactgcctgggcgtgcaggacccgctgccggcctgggcggaaagggacggctcgcactacgtgcagaccaaagacccgctggtcggcgcgctgcgcgaccggatggccgcggcaccggtgatcaccgaatggtgccagctgccggccgggaccgatccgcggtcctactacgaaaagggcctgcgcgacgtcatgaagtaccacgtgtcgatgacgtcgagcttcaacttcccggcggtggatgcgagcaccccgatggacccggcgctgtacctgctgtgggcgcaggccaacgtcgtggccggctaccggtattcggccgaggcgcggcagggatcgcaatcgttggccgacggcaaggcgacattggacgtcacgtggaccaattacggttccgcggccgccaccgagaactgggtccccggctaccggctggtcgacttctcgggggcggtggtgcgcacgctgcccgcgcgggtgacgctgaaaacgctggtgccgggaccggacggcgcgggcaaggaacccgccccggtgtcgtctgtcgagaccgttcacatcgacctggcgggcgtgtcgccggggcactacacgttgtgcgcggcggtcggttggcaacagcacaagccgggcgccgagcacgtggtgaactacccgcccatgcggctggcgcgcgacggacgcgacggcaacggatgctatccgctcgccacgctgaacctggcgcgcgaagcctcgaccgcctgatcccggcggcgcaccacctggccgaacaagccgccggagccgtggtgaacccgcgcagcgggacttccgattccgccaaaccccgcctgacgatgctgcataatctgcaggagcagcgcggccgctaccggaaagccgaagacttcgcttcgcgctgaaggcttttagaaaggttattagccgatggatttccgtaccttcgtccggattctcggcgcgcactggaaactcgccctgaccgccctgctggcgtgtaccgtcggcgccgcgttcgtcacggcactgcagaccaagcactaccagtcgtcggccacggtcctcatctcgttctccggtgccaccgacctcaacgaggtgtacagcggcacggaaacggcacaggaacggctgtcctcctacgcccagatcgccggcgggcacatcgtggccgagcgggccatccgtcagctccagcttccgatgagcgccgacgatctgctgagccagacccaagtgaaatacaccccgaagtcggtgatgttcaccatcagcgtcaaggacaccgacccggcgcgcgccgccgcgctggcgggcgccatggcgaatcagttcagcgcgctgctgccgacgatcgccccgaacaccggcccgaacacggtgggcgcgcaggcgaccgcggggccccgacccgaggtggccgaaacgacgccgccgccgggccagccgccggaagcgccggcggcggtggggccgacgggcaagccgtggccgctcgcgcgggccaccatggtggagccgccccgggtgccgaacgtcccggtttcgccggtgccgctgaggaacatggtgatcgggttcatcgccggtctgctgctggccatcgcggtggcgttgacccgcgaggccggtgatcgcaccgtgcgcacccgcgcgaagctggaagagctttcgggcctgcccactttggccgagctgcccggacggcggggcgggacaccgcggttcggcaccgacaccgcattcgacgacgcggtgcgcggcatgcgcacccggctgctcagggcgatgggccccgacgcccgccaggtgctggtgaccgggccgttcggcggcgaaggcacgacgaccaccgcgatgaacctggcgctcgcgcttgccgagatgggcgaggacgcactgctcgtcgagggcgacagccgccggcacgtgatcgccggattgctgcgcgtcgaatcgggggagggactcgccagcgcgctggccaaccccgccgccgcggccgaagtcgtgaagccgacgccgatttcgcgactgttcatcttggcgtcgcggtcggctcgccgcgaaagtctgcctcccagtgcgtatttgccggaagtggtcgaccgggtggtgcaggaattgtcctcgcgcttcgaccggatcgtgatcgacgggccgccggtgctggccaccgccgacaccggcctgctgtccggcgccgtcccggccacggtgctggtggtccgggccaagcgcaccaccgccgacgaactgcaggacgcgttgaccgcgctgcgtgcggccggggcacacgtggtcggcaccgtgctgaccgatgcccgccagtcgctgcacatccgggccgccgaccgcgcctaccggtcgaaggtcagcaggccggcgtgattccgattccgtacctgcgggctcggcaccgcctggcagtggacggcgtcctgctggcgatgttcgtgttcgggtgcttcgtgttcggggtgctgtcggtgcgccggaccaccgagggggtgctgctgaccgccgcgttgttctgcgtggtggtgtattgggtgaaacccgaagggatggttggggttacgctgttcggggcgttcgcggccctgcccgaagggttgcacgtcggcaaagtctttggcccgctgaccatttacgcctaccacctggccgccttcctggcgatctgctatctgatcccggccgccaaaccgcggtcctccgatttcctgctgcccgggatcctggccgtcaccgcggtgtgttccaccgtcaccgggttcctggtcggaaactccgcgctggtggtgacccgcgagtcgaccaccatgctggaaatggccctcggtttcgtgctcgcgttgttcgtcgtctacagcggtcacgtcatctggtcgatccgggtgatgatcgcgattctgtggttttcggcgggcatggcgatcgtgagttcgttgtactccatccggttggcgggccgggcggagagcctggagggcaccacgggcgccggccaggcgatgcgcatcattctgtccacccagacgccggccaccgcggtgctgagcgcactcgtcgccgcgcccatcgtcggccgggtgcggcccaggctgtatctggcgttaggcccaccggcactgagcatttcgctgctgtccttctcccgtaacacgctgatctccatgggagtggcggccgcggtcgccctgctgggcagcctgagctgggcggcggtgcggcggacgatcgtggccgcgacggtcggcgcgaccctggtcgcggtgacggtgcccgggtcgctgtttttgctgcagcggtcgaagaccggggcgtggctcgccgaccagtacgtcgcattcagccagcgggtgctgggcggggtgacgtccagcgcgctcgcggtggacgattcggcgctggaacgactgcgcgagatcaaccttctcaaggaaaccatcgccagcgcaccgcttttcggccacggcctgggctacgtgtaccagccgccgaccggggacgacgaattccaccgatacctctatccggcgtattcgcacaacttctacctgtggtggttggccaaggccggggcggtgggcatggccgcgttcgtgttgttcgcgctcacgccggtgatcctggcgttgcggtgtacgtccgggccggccaagatcgcggcggcggtggccgcgggcctgctggcgatctccgcggtgtggccgttgccggagatgccgatggacgccctgggattgggcatggcgctgggggcggcgatgggctacgccggcctgcgccgacgggagaggcagctcgacgaccgctgcgcggcgcccggccccacctccaattcccctgtcggcgtgggcacttccagctagtcggggtcggccacgatgatcgcggtgacacacgtagggcccgacaggtacagcatcggcggcacgcagtccgtcatccgggtcatccacgacaacaacatcggcgccgaccggattcgcgtgctgtcgacgtggaacggccccaaccaggtcaagaacctgtggctcaccgcgcgggcggggaccacactggcccggtcagcggccgagtccatcgtgcacttccacgtctccaacggcggcgcctggctgcgcgaaggaccgttgatcagattggccagcgccaaagggtttcgggtgatcgtcaccctgcacggctccgactttcccgagttcgcccggagccgcccccgcttcgtggccgccacgttgcggcatgcggacaaggtgatcctgctgtcggagcaggcgcgcgccgccctgctggaggtggcgcccacggtgcgcaccgccgtggtgcccaacccgatcgtggtcgacgaggaggcgcccggggccggctcgacgccgcccgtggtgctgttcgccggcaccgtggggcgccgcaaaggggtggatcggctggtcgcggcctggaagctgcttctcgccgagggcatcgaaggccgttgccggataatcggtcccatcgacgactacgtcccgcctgccaccgagcggctgaccgtcgagggcccgattcctcccgaccgggtccgtgcgctgctccgctcggtccgggtggtggcgctgccgtcgttcgccgagggaatgccgatgatcctgaccgaggcgctggccggcgcgcggccgttcgtggcgactccggtcggcgggaccgcgcagatcgcccccgacccgggcatgctggtcccggtcgacgacgtgcccgcgctggccgacgcgatcggccggtacctgcgcgacccggagctggcgcagcgggacgggttacgcggtcaacaacacatcgcggccacccgcagcccgcgcgtcatcgacgccgagctgcgccgcatctaccagggctgcgacgttgcggcgggttgagctcgccggagggcaattgacggtcagcgcaatgggtttcgggtgcggcgcgctgatgcagtcgccgtcgcgcaaggaccggatggcggtgctcagcgccgcgctcgacagcggcatcacccatttcgacaccgcacgcatgtacgggctggggcgggcggaggcggagctcgggaccttcctgcgcaccgtcgaccgggacagcgtcaccatcgccaccaagttcggcatcgacgtcggcggcgcggcccgccggctcggccgcttccaggcgccggcgcgcgcactgctgaaaaaggcgcccacgctgcgccgcatcgtcaagcggcagcaggaacccccggcgaccgcccgggtgtacgacgccgccggcgcggcgcgcagcctggagcgcagtctgacggccctcggggtcgattacgtcgacattctcttcgtccatgccccccggccccaggacacggtcgccgccgcgcaactgtgcgaattcttcgagcgcgcccgcgggcagggcaaaatccgcgcctggggggtttcccaggacgaggggctcgaggtcgacttcgcccgcgcattcgccccgcacgggatcagccagctgcgcagcgacctgctcgaccccgccccgcgcgcggccgatcttgcgttcgcggtgctgcgccggccgcacgccgccctgtccacggccctgcgggccgaccccgagctggcgggccgctggcgccgggccctgcagctcgacccgctggcacccggtgtgctcgcccggctgatcctcgccgcgtcggctaccgcaaccggttgccgcgcaatcatttacagcaccacgcggccgccgcgggtggccgaggcggcggccgccgtcgccgccccggacgccgagaccgtcgcgcggttcctcgccctggtcaccgagttccgcggggggcgggccggatgatccgcggcgcgcgggacttcacccccggcatgaccatcaccaccgacgtggcggtcgtcgggtccggcccgatcggcatcgtgaccgcgctggaactcgccgcctcgggtgtgcaggtggtgctgatcgaaagcggtgcgcagcgcccggaccgcgcggcgcagcaactggccgaattcgattcgcggcacgacgactatttccattcgcgcagcgggctgacggtgcgccggcaggtgggaggaacctcggcgctgtggggtgggcgctgcgtcaagttcgaccgcatcgacttcgagcaccggcttatcaccgaacaggcgccgtggccgatcggatacgacgacgtcgagccgtacctgcagcgggcctgcgactgggcggcctgcggccgggcggtgttcaacgcccgcgacatccccgaactcgcgcaccgggacctggtcgccgggctgcccgacggcgccgtccgcagcaccgacctggagcgctgggcgctgcccacccggttcggccggcattatcgaaaagcgttgcggcgcaccgccggactgacgctgtggaccggactcacctgcaccgagatcgtgaccgagccggccggcggccgcgtcgatcacctggtggtcaagacgttgcccggcgcccagggcaaggtggtcgccaccgactacgtcatcgcgaccggcggtttggaggccacccggctgctgctggcctccgaccgttatcaccccggcgggctgggcaacacgggcggacacctgggccgctggtacatggcccacgtcgaaggacgggtcgcgcgggtgcaattcagcaccgaccgggtgatccacggatatgaacgcgacggcgacggcgtgtatgtgcggcgccgcttcaccttcgacccgggcctgctgcgcgaagccggaatgtccaatgccgcaatatggttggtgaatcccccgatcagcgacccgagtcatggcagcggcatcctgtccggggtgtatctgacgctgatctccccgctcggccggttcttgctggcggcagcgatccgcgaggcgcacaccaagacggacggcccgccgcggatactggcgcatctgcgcaacattgcggcggatctgcccggctcgatcgggttcgcggtcgcgttctgctacgcccggttcgtccggcggggcaggaaggcgccgggcttcttcgtgcgcagcgccgacaaccggtacctgctgcagtaccacggcgagcatcttccgcactgggagagccgggtcgaactgtcggacgaacgagatagcttgggcatgaagcggattcgcacccgcatgcatttctccgacgccgactacgccagcgtgcgcacggcgatcggtgtaatcgacgaacacctgcgccgccacggggcgggacgggtggagtggttgaccgacgacgtcgaggcctcggtgcgcggctacatgcggcggcgggccggtttccaccaggccggaaccacccggatgtcggcgtcgccgaaagacggtgtggtggatccccagctgcaggtgcacggggtgcgtgggctctacgtcgccgccacctcggtgctgccgacgtccagccaggccaaccccacgctgctcgggatcgcgctcggcgtccggctggccgagcatcttgcggcctcgcgcgcctacccgggctaaggggcggtcaattcgtcgatcgggccgacaccggccagaactcgtcgatcagcgacttcgtctgccggatgttcgccccgctggacgcgccgaacacgatcgactggatctgcggctggcggcagacgtactcgatggccgcacgcggctcgatcgcgccggacgccagcacggacatcgcgatcagccggcagcggcgctcgcggatcgtcttctcgtacagctcgattccgccgcacatccggaagccgatcttgttgaaattggcgcacacgatcgggttttcgatcccttgcccgtcgagggcgtcgagcagccgcggcaggttcatcgtgatgaagcccggctcggcgccgtacttgagccggacgtggtcggagaagaagcggaacgcgtcgtgcatgccgagcccgagcagcaggtcggtgaccacgttctggatgaagatgaccggcgtggacaacccggcgaacatcttcatctcggcgtccaccaacagctgcatgatcggctcgatgtccttgccggcgagggcgacaccgcccttgaacatcgaccggaccgccccgtcgtcgggcaggaaccggcgcagcgcgtcgagcatgccgaactcggtcacggcgttggcgtacttgtgcgcatacggcatgcacgggtagaagacgtaatcggggtagcgggaacggttggcgcggaagtgatcgcagatctcgccgacccggtcgtgggtggtgcagacgaaggtgcggatgccttcccggtaggcggcgtcgagcgtgtccagcaccggcccgaggtgctggaaccggatcgcctgggcgcgcgccttctcctcggacatgtggttgaccccgaagaactggttgtcgccgaacagcacccggtccatgctcacgacgccctcatggccgcgagttttttgatgcgcgcggcgatctcgcgccgaaacgcgccgcgcggcgacccgttgaccgcggggagggccggcgacgcggggcgcccggccagggcggcgccggtgatcatcgccacgacacggtcgacggcgagcgcggagcggaacgtgttctcgccgtcgcggcggttgttcttgacgctctgggcgaaatagtcgatctgcgccgaatactcttcgccccgaaggtaataccagacctcgtcggtgagctcggtggtgtagcggatcgtccagcccggccccaactcggggagcccggggtgcgtttcgcgaaggtagatctggcactcctggcgatcggcgacgaggcggccgttggtcccccacaccgagattttcgtcgacatcttgcggaagctctcgtcgctccagttgacgcacaactggccgctggcgccgttgtcgtagcgcagcgtgcagtagacctcgtcgtcgacgtcgcgggagaagacgctgtgccgcaccaccccgtcgaccgaatgcggcacaccggcgatgaagttcatcaaatcgatggcgtggcaggcatagtcgtagagggcaccgccgccttcctccttcacgccgcgccaggtgctgcctttcgggcgtagcacgacgggcccgtaagcctcggcgcgcacgtggtgcacctgcccgagcccgccggacgcgacgatgcgtgccgcctcccggaaggcgccgatgaagcggcagtggtagccgacctgggtgacgagccgattggtctccgccaacgtcaccaggcgctcgccgtcgcggacatcgagcacgaacggtttctcgcagaagacgtgtaaccctcgggcaagggccttttcgaccatcggtgcgtgcagccgcgacggcacggccacgacaaccgcctgggcccgcgtgtgcgtcagcatccggtcgaggtcgtcgtagcagtccagacccgtgtatttgcccaggatgtcgcgcagatagcccgcggagtcacacaccccgaccacgtcgaggtccgggtgggtgcgcaggatcgccaggtgcgaaagacccatttttcccaggccgaccacggccgttcgaatcatgctccgcgccttcactcgcttccactgccgcatcggcaacgggtacggcccgccaacaccgtggacgttagcaccgcgggcggatcgtcaacgcgaaatccggtcgatctcttcgtcgtcggtaatccccgaacgtgggcgggcgcgggagttagtcttttcaaggcgatctcggccccgccggccgcgcggtggcatcggatcgtcgcggcgcagccggcgggccggcgcgagcgcctcaggtgaggggagacatgggccggctgctgctgatcgcctcgtcgggcgggcacatctacgagatgttctgcctgcgggagttctggcaggacaaggatcggttctgggtgagtttcgcgaccgccgacgcccgttatctgctgcgcgacgagccggaggtctactgggcggcgcacccgaccgtccgtagcgttcccaacctgctgcgcaacctggtgctcgcgctgcggctgttgacccgccaccggccggccatgatcctgaccaccggttccggtgtggcggcgccctttatctggctggcctggctgctgcggatccccgccgtgttcgtcgagtccgtcacccgcatcaccgagctgtcgctgaccgcgcggatggtcaagccgttcgcctcccacctcctggtgcagtggcccgagctggccgagaggatcccggccgccgaataccacgggaggatcgtgtgatcttcgtgatcatgggcatggaggtgcatccgttcgaccggttggcgcgcgcggtcgacgagctggcgcgcacggacgcggtgggcgaggagttcttcgtgcagctcgggacgtgccggttcgagccgcgccacgcccggttcgagcgcttcttgtccttcggcgacgtctgcgagcagatccggcgcgcctcggtcgcggtcacccacgccggcgccggatcgacgctgctgtgcatcgagcagggcaagcatccggtgatggtgccgcgccgttcgtcgcgcggcgagcacgtcgacgatcatcagctgccgttcgccgagaagttggccactgccgggctggccacggtggtgcgcgagaccaccgagctgccggcggccatcgcggccacccggtcccggtcggctcccgccgatgcgctgggccgggcccgcgaactcaccggctggctggagacgttctggcgcgggttggcctgagcatccggtcatcctcgccgcgccagcacctcggcgaccacgtccaaaatgcgttccgcgacaaggtcgaccgcgcaccggcgctggtagtggcgtgcggcctcggcaccgtgccgcgcggcggtgaccggatcggccagcaggtcgaaggcggccgcgagcccggcgacgtcgtcgatgccgatcggggcgcagcccggcggttgatactcgggcaacgcgccggcggtcgacacgatcggcatgacgcccagctgcatggacagcgattgcacaccgctttgtgaggcgcgccggtaatgggcgatcgatcccttggcggcggccagggtggggatcacgtcggcgtagcggaagctgccgttgcgccagcgggtgtgtttgggcagggttttcacgtcgagcggcccgtcgccgatcagcaccaggttgtcgccgcgccagccgccgccgaccacatgccgttgccaggccgcgagcacgacgtcgacgttcttgtaggggttgagccggccgaacatgacgaaatcccggcgcccctcgggaccgacgaacggcggaacccggtccaggtcgaggtcgctggccagcggcaccacgcgcaccggggtgccggcgacgtcgcggcgcgccgagatggccgccgccacatagtcgctgtaggcgatggtggcggccgatcgtgcgccccagcggtcgaacacggcccgttcgtaggccggtgtcagttcgtcggggtcgtgcggccggtcgtcgtgcaccacctggatgcgcggggcccacccggccagcgcgatccagcgcggatcgcggaccagctcggcgagcaccacgtccggccggaaccgccggacgcggcgccaggcgcgcagggtgggcagccaggtggcggccgtgcggaatcgcgggtcgagcaccagctcgtagtcgcgcgcggcgtcggactccgggtgctgatcggaggtgaccagcaggacctcggcgccgtgccgctgcagcgcctcggcctgcacccgcaccgccggccgcgtccacggcgaaagccacagcacccgaggggaattcacaacacggctccgatcgcgtccaggtaggcatcggccatggcctgcaccgtgtagtgcttgcgcatgcgctgctggccgcggcgtcccaccgccggcagcgcgtccgggtcggccatgatccgggccagacattcgcgccacccggacacggtcaccggctcgacgaggaatccggcccgcccgaaatccagcatttccgggacggcgcagatcgccgacgcggcaacgggcacgccgcgcgccatcgcctccacgatcaccagcgggaacgcttcggagcggctgggcacacacagcaggtcggcgtcggccagtgccgggccgggaccggccgcccagccatgccagcgcacccgatcgcgcagcgccgccggcgtgcccgcttccagccgctgccggtccggaccgtcaccgaaaatcgagagccgccaaggtatttcggccagcccgcgcaaggcctcgatcagcagatgcgggttcttgtgctcgacgatgcgcgacagcatgaccaggtgcagcggcgcaccgtcggcgcgccgccgcggggccgggtcgccggtgacgaccaccccgttgggcgcgatgaagtggcgcccgcacagccgatgctggtcgagcagcatgtcccaatgccgttgcgccagcacgatgaaaccgtccgccctgcgcatcgcggcggtcagcggccgcgagtagatgggccggtccggctccggcggaacatgcggggcgaccatccagcgccggccgcggccggcggcccgccacagcgtggcgaaccccacctcggtgttggtgtcgccggagatcagcaccgccgggccgtcggcgacgtcgatgatcggcgcccaccacggctggcggatcacccgcaccgtgtccgggatttcggcgatcagcgggccgaaccgctgcacgcagacgatggtgaccgggtagccgcgccggtccaattcggttgccagaagcgctttttgccgctcggctccgccgtagaccaggcggttggtggtgatcacgaccgacggcagctcggtgcgccggcggttcggccgccgcagtcgcccccacgcggcggccccggccaggtacgcatccgcgcggtgcacgccgcgccgatgctcgagcaggagggcggcgttggcgcgcgccaggtcacgattgcgccggtgcgccgcgtcggtgaggcgttgcggcccggtcgccgtgtgctcgacgccgcgttcgtcgaccgtcaggacacgccagcccgccgcgtgggcccgggcctgccagtcggccgcctcgccgtaaccgaagaactcttcgtcgaaggcgccgagggcgttccaggcggtgcggttgatcgccaggcacggcgggcgtcgcgtcacgaggttctccggcgtgcgacggcgcgcgctcgcctcgggagccatcggcgacacggccgccaccccgggccggcgcagcagctcccgggtccgggtcagcggccccagtagccgggtgccggcgggcagcagcaacaggtcggcgtcgggcggtgcgtgctcggccagcacgttgaaggcgacggcaggggagacgtccagcggacccgaaacacagtgcaccccagggtatttcgtcgccacctcggcgccgtaggcgtacacgggcaggtcgggcaggtgctcggcgacgctggccaggcacgtattggtgcggtcgcggtcgccgtcggtgacgatcaacagcgccagcggccgctcggccggcagcgcgatggcaccgccggccgagcgcttcaggtatgcccggtctgccttcgacgtcatgccgccggctgcttctcacgcaacgaggcccgcaacgaggccaggctggaccaggtgatggggccgaacaccgcgctggtggtcaggtaggccacggccgccgcggtcagcaccaggatcacatggtggcccgaaagcagcagcgccacaacgacactcgcaccggtgggaacgagcagccgcagcacgaacgcgaccggggtgcggtagccgcagtggcggcgcagccaccaggtggagacggccatgttgaacagttccgtgcacaccagcgccacgcccgggccgacggcgccgtaccgccccgccagggcgaggttgagcccgacgttgagcgccagggtcgcgaccgtcaaccacagcagcacccgttggtgatgcgaggccaccaggccctggcccagggtgccgccgacgaaccgcagggccgccgcgacgaacagcaacgccagcgtgggcgtgccgcgctcgatgaacgcgctcttgccgaacaatccgatcagcggcccggcgagcagcgcgccgaccacggcgaccgggaccgccacgaaggacatcaattccacgctgcggcgcaggaagccggcgaatgcggcgacgtcccgcgcgaacagctcggtggccgtcgacaacgtcgacttgtggaagatcagcgagaccacgatcgtgttgaacgcgatcgtcagggccaggccgtagacgcccacctcggagtgggtgctcagcagggacaggatcacgccgtcggcacggcagtacagcagcccgacgatcagaaaaccgatcagcggcaagctttcccgcaacaaatcggcggcctcccgcggggcgaacagcggccgcaccgagatgtgccgcatcgcggccgcgccctggatcagcagctgcacggcgggcgggatcagctgggcgacggcgaaccagatcacgttggcgtgcgctgcgaccaggcaggcgaccatggccagggtgcccacccgggcggtgacgtcggagatggccaccgccgagaaccggacggtggcaaggaaaaccggctcgaatcgcgtcgtcatggtctgcagcagcagtccacccgacagcacgaccagcatcacccgcacctcggtgtcgtgatagatcagcaaccccgaccctgccgccagcgccgcgagcggaacgcagtacagcagggccaggccgctgttgatgcggaccaggcgctccaaatcgccgcggccggaagtcacccgtcgcacgatcacggtggcgatacccagatcggcgaagctggtccacatggcgacgaacgccaccgcgatggtgagctggccgtagcgtccgggacccagatagcgtgcggtcatcgccaccgaaaccactgaggccagcatccccagtgcgcggcagatcaactggaccgagaacgcgtgggccatccgggccagcggcaccgagggcacgaccgcggcggctgccgtcggctcactcatgggtggcgagtttaataggcgccgtggctcgtcaagacggctttgacggtcttggcgatgatcatgagatcgcccgccatggaccagttgtcgacgtaggacaggtccagccgcaccgattcttcccaggacaggtcggagcggccgctcacctgccacagtccgctgacgcccggcttcaccagcagccgccgcttcacgtcgccgtcgtagctttcgacctcccgccgcagcggaggccgcggcccgaccacgctcatgtcccctttgatcacgttgatgaactggggcagctcgtcgatgctgaacctgcgcaggatcctgccgaccggggtgacccgcgggtcctggcgcatcttgaacagcaccccggcgccctcgttcaccgacagcagctgctcgagctgggtgtcggcgccgtcggtcatggtccgaaacttcagcatggtgaacggctttccgtctaggccgatccgctcggacgggtagaagacggggcccttgctggtcagcttgatggcgagggcggccgcgagcatgaccggcgccgccgcgatcagcgcggccagcgagaacaccatgtcgaaggcctgcttctggaagcgttgcgtcccttcgtattgcggcttttcgacgtgcagcaggggtagcccggcggtgaggcgcagggtcaatcgcgcttcggcgacgtccatcaccccgggcgacactaccaggtcgacgtccatggtctccagctgccacatcagctcccggattccgtgcacaccgaaatgctcggtgcgggtgaccgcgacggtgtccgcgccggtgctgcagatcgcggccaccgcgtcggtttcgtcaccgagaatcgggacctcgtgcccggcgacggtcaggatctcgccgcggggcgggccgtatccggggatgcagacgccgaccacggtgcagccgttgcgagggtcgcggaccagttcgtgcgccaggtgggtgacggcctggcggtcgccgatggcgaaaaccgttgtctggcaatgcccgtgggcacgctggcgggagatgtgctggcgccacaggctgcggctggccagcaggcccagggtgccgacgggtagggcgatcgccaggtagccgcgggccagatccaccttggccaacagggtgaccatcgcgatgatgccgaacgtccagaacgacgcgctgccgatccggcggtattcgtcgatccccgaaccgatgattcgcgtcgagcgggtctggaacaccgccagggccgacagccagagcagcgcgaacagcacggagaacagcgtcatgaccgggtcggagtagccggaggtgttcgcgacctccccgaatcggacgtactgtgcgaacagcaccgagacgaatacgatcaccgagtcggtgacccgcaggccctgcgaatagtggtcctgccaccgccgtacggcggtgccggcggccgacgtcggcgcgccggcaaccgccggccggccaccggttccgtcgcgcgccacggtggtgagggccgccggccggtgcttcggcgaccaccgagcgggcatggcgtccaccgtgttacggatcatcaccgactgaggcatggtgccacctgttccattggtgccaatctggtctgggctgagggccagctcgcgtcctgctcggagatgaccgtgaccggtatcggccaggtgactccgaattccgggtcgtcccagcgcaatccctgctcttcggccgccgcgtgccgcccactggtgtggtaggtgacctcggtgtcgtcgaccagcgtctggaagccgtgggcgacgtagggcggcaggaacaaagtccggtggtcgtcggcggccagctcgatcatcacgtggtcgccgtaggtcagcgagtcggggcggacgtccaccgcggcggcgacgatggcgccgcgggtgcagcgcagcagcgtggcctcggcgtgcggcggcaccgtgcggtgcagcccccgcaccgtgccgcgggtgtagttgaagacgatattcgtctgcgccacatcgagattgagcccgtgagcggcgaagtcgcgggcgcagaacgaccgccaggtaaagccgcgatggtcgcgacggagttcgaggtcgatgatcgtcaccccggcgaccttggtgggtgtgtacttcacgtaccgctccttcttcccggcggggcttaggcgtatccggcggacggtgggcgggtcatcaccgtcgggatgacgccgtagcgcgggccgagcgtcttgcccgatgcggcggccagccgcggcagcgagcccatgacgctgggcggcacgttcgcgccggcgaggttgatcgtcggcagcgcggagacggcgctgtgggcggccgggatcacgctcgtccagctcgccggcaccgccaacggtcccaacgcggccgctttacccagcgtgccgagcacgccggagcccagcgatccgagcgccccggccccggagctggccgcactcgcgacccccgacgccgcggccgccacaccgtcgccggcagccttggccaggccctgcgcggtctgggcgatgccgaggatggacgacattccgtacaggggcgtggccgcggccgagaaggcgctgggaatggcgccgggtatgcccgaagccaggcccgtcatgatcgacgacgtggtcgagttggccgccccggccgcggcgcccccggcggccccgctgccggtgtccgtgaccgtgtccagcccggcggtcatcggtgaggaaagcccctgcagggtggtggggatcttggacaccgtgtggttgagttcggcctgggtggtgacctgcccgaccaccgcggcctggcgggcgacgccggcctcgtcggtggtgtcgggcggcggggtgaacggcgtcaccgcgcaggcggccgccgagccggcggcgtattcgtacatcgcggcggcgtcctgcgcccacatctcggcgtattcggcttcggtggcggcgatcgccgcggcgttctggccgaagaagttggtcgcgatcaacgtcgcgagctggacccggttggcggcgaccgccggcggcgggaccgtcatcgcgaaggcggcctcgaagacctcgacggcgaggcgggcctgaccggccgtctcggcggcccgaccggcggcgccggccatccaggccatgtacggcgcgaacgcggaggccatcgccagcgacgacggccccagccagcgtccggtggtcagcccggcgatgaccgagcggtagcaactggccgcggcgtgcagttcggcggccagcgcgtcccaggccacggcggcggccgtcagggacagcgggccgggcccggcatacattctcgcggagttgacctccgggggaagcgctccgaagtcgatcacgtcagctcccggccctgcgcaggaccgcggcggcggaggcggcgccggcgccgccccacaccgtccatgcagcggaaaagtcctggtcagccgaggtctgtggcccctgcggggccggtgaccagcggttcgccgtgacgaacgacatgtgtttccttacctttcttgaagggtgttcggggccgtcggccttaggcttcgaattgcccagggacgtcgggtatggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttccggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatccccttacgcggaaaagacgaccgagacgttgtttagcccgtctgcaaactgaccatcgtacaatagcgtacaaaacatactaatagtttgacaatacactgtgacctagaccgcaggtatttaggagcgcgtcaaccaggacagccgtatgactgctaacctctgtggtgggctaaatgtctcgagcgacgcgaatccgtgttcgctccgatccccaaaaagaaccgaggtacttgtgccctgctcgagcaacggcgtcgtcaacgcgatggccggcgccacggcccgcggcgccgggcccggcaggaacgcgtgcctcatcaccgcccccacgggggagccgagctttcgagcacgatgaccacccattcgaccgacggacgagcggatgcgacccggcaacagatcctgcgggccgcatcgcaccagttcgcccggcggccctaccacgacgtcggcctcgacgacatcctcgccgaggccgagctgaccaagggtgcgatgtacttccacttcaagtcgaagcacgcgctggcggtcgcgatcatcgagagccagaccgccagcggcgccgtcgccgtgcaggacctgctgacccgcgggctctccggcctggagacactgatcgacttctcctatctgatcgccgtcaaggacatcaagacggacctggtccggtccgggctcaacctgatggagtcggtcgggctgtccgacgggttgcaggagaagctgttcgaccggtggatcaaggccctggcccgggtcgccgagcaggccaagggcgagggcgacatcaacgagcactgcgatccgcaggacatcggccggttgatggtgtcgctgcacatggggctgcgcaagaccagcaacctggacgacccggaacgattcctgcgcgatctggagaagtgctggtcgctgctgctcaccgggatcctgcagccggaccgcaccgagtacttccaacagttcctgcgcaggcgtgctgccctcgcgatcaacaccagttcaaccgatgatgacgagtcctagcgaccgggccgacgcgcggtccgcgcatccgacgagcctgcgggggtgcgggggcgatggcccgccaagttcggtctgaggccacccggcagaagatcctggactcggcgatcgaagtcttcggcgaggtcggttacgccgcggccgggtggagcaccatcatcgaacggaccggcatgaccaagggtgccctgtatcaccacttcgattccaaagaatcgttggcgtccaacatcatcgaggagggctccgaccggctgctcagtgcgttccgcaacgtgtgcgggtcgtcgtcgccggggctggaaaacctggtgcacggcaccttcaccatcgtcgaggtcttgcggtcggacaaaatggtgcgcgccgcagcgcaattggccaccgcgctaagcggattcaacggtgcggcctcgcgcttctacgcgaatttggtgctggaaacggcgcaggaggcgcggcgggcgatcaaggaaggcgacctgcgcgacgacatcgaccccgacgtgctgagcgcgtcgctgatgggcaccatattcggggcccggttgatagcgagcaccatttccggtcacggccgaatcggtgacatcatcggcgaccccaccgcgcggttgcaccagatctggagcctgctgctgcccggcatcgtctcgcaggcatcgctgccgtatttcgagcaattcctgcgccgcgagggaatgcgccacgccacggccaaccctgccgcgcaaccggaaggcgaatagccttcggcgagagccgttgcccgggtgccgcttcggtcgtcacgatcgcatttccgttattggggttgaagcgctttcaacaatgcatactgttccggtgaagttgcggaaatccctcggccgggtaatcgcactggccggtgtcgtcggattcttggtgaacagtgtcccggaatcctgggccgcgcccgccgatccgagcgccccctcggactcgacggcgagcacgaccaccaccacgacgacgctgtcgatgcccgacctcgggtcgtcgtccaccctggaattctgggggctgaccagcacccagcagttgtcgctgccggtgctgcacgggctgaccccgaccgcgctgaacgcgacggtggaactgccgatcaacctgcggtccgggttgctcaccgtcacccagggggagcgcaccatcgccaggctgaacctgcccaccaccgaccaggcgccgctggtcgtcccgctgaacggggccgaggtgaccggcaattggctgaacgtgacgttgcgggcctacctggtgccgttggacggctactgcctgtacccggagagcccgctgcggctggtcaacgggaccgtcaactacaccggcaccgagctgccgcccaccacggtgtcccacttcctgccgccggtgctgcgcaagctgaccatctatctgccgcaatcgccgtcgacggcggagtccgacacggcgattcagctggccaccgccgccgccgcgcactacggcaagcaggctcccgacatcgtggtggtcccattgcaggaagggcaggcggctcccccggcgccgccgcaatcgctggaacgccaggtcgtcatcaaagagggcccggacaacgggctttcgttgcagggctccaccggggtgccgtggttgctggtctcggggccgctgaaccgcaccgacgaatcggacaccgccctgctgttcagcgacctgtcggatatggccctggcgtccaaggtcgcggtggaatcacccaagcccaagccccaattgccttcggacagcgccactttgcgcgaactgggccagtcggtcgtcaacgcgacgtcgctgcagccccgggtctcgatcgggctggaccagacccgcttcggcagatccgtgcattcggtgcgggtgcatctgcagggttcgtacacgccgacgccgagcaacatcgccggccagatcgccgtcacggtcggccgggagaccatcgaccactggccgaccgacggccacggcaccatcgaccgctgggtcgacgtgcccgatcggctgctgcagcgctacaccagcctggatctggttctcgacgtcgcgagcaacgtcgggcattgcggagacttctacaccgccggccccggcaaccaactgctcacgctgaacatcaacggcgacagcgtcatccagagcagcccggccgcgccgccggtgccggacgggttccagtcgatgccccaatcgctgttgccccgcctgcaggtcggcatcgccgagcactcgttcgtcgacacggtgcgcgcgctcgatctcctggtgggcctgcagcggatcagcgcgataccgatcgacaccaccgtcaccaccgtcaaacaagcgatcgactcgtcgaatccggcgctgctgatctcggccgacgggtggaaccagtccgacgtgacgctgccggtggccgccgggcccagcggcccgatcaccgtcaacgccgtcaactccggcgacaagcccaccaagctcaccttggacccggtgctgcgattcgcttctctgcaaacggttttccaccacggcaggtcgctgctgatcgcgacgtccaacggcgcggccggacagctcgacgagctgatccggtggctcaagagcgacaccgacaagcactggcagcggctcaacggcgtcgcggtggtgtcggtgcccggacaggatccggtcaccgtcgaccatccgccgctggccgccggtgcgtccgccgcgggcgccgggcatcactccgacctggactggctgtggtggttcggcgcgggctggctggcggtggccgtcgtcggcgccggggtgatcctgtggcgagtgcgacgcgaatcatggcggcgccgctagggtttcggccccgagggcacgcttgagagccatcgcgacgcgcgcgaccgtcaagaacgcggcggccgcattgctgtgcgccgccggggtcgacgcgctggcccggcggcgacaccgcgacacgctcgccatcctgatgttccacggggtggaagaccgaccgccatcgccgccctgctggcacgtgtcgggcgccgcgctgtttcgccgccaattgcggtacgtgcgcgcgcatttcaacgtgctcgccctcgaggacgccctggaccggctggccggcgggacgctgccgccgcgggccctggcgatcaccttcgacgacggcacccgcaacctggcgacccacgcgatgccggtgctgcgcgagctggaactgcccgcggcggtgttcttggcgaccggcccgatcggcaccgaccgaacgctgtggcccgaccggctctggctggccatcgcccacagcccggcacgcgaaatcgacttgacgccatggggattgggaacccgcccgctgaaaagcaacatcgagcgcggcgcggcctatacggtggtagtcgagaaactgaaaaaactgcccgacccgcagcgcatcgcggcgctggacgagatcctctgcgtgctcggccatcacgacgacggcgacggcgggccgttccggatgcttagctgggagcaaatccgccaactggccgccgacccgctggtgacgctgtatccgcacacggtgacccacccgatcctggcccgttgcgacgacgccaaactgcaccgggagatcaccgagtcatgcgccaccatcgagcgtgagacaggctcgccgccaacggttttcgcctaccccaacggccggttgcaggatttcgacgagcgggccaaggacgtgttgcgggcccgcggggtgcgctgggcactgtccaccgcaccgggattcgccgaccggagctgcgacccgctggcgttaccgcggttggcggtgggcggcgacgcgtcgttgaactacttcaagctgctggtctccggcggactgccgcgccgttagcgcgcctcttcccaaagctgttcggtcaggtcctggaacgcggccagggcgaactggtcgtcggcgcgcatcaccgccgacttgctcatcatcgcgcgaaccaccgacccgtcccggtgcgccagttcgaccaccatgttcgccagcgcatgcaccgtcgccaacagcgactccgacgccggggcgtgatggaagatctgctcgaagcgcagcgccagtgcctcctggggctggtagcccagcatgtcggcaaatgcggtgtcggcgaacaagatactgccgtcacccgcgatggccagcacgggaaccgggatccgctccagcacgaccagtgcgggcagctccctgagggtggtcatcggcgattggctgtgttgccggttctggcgtcgttccacgagccgattatggtctatggcacaggttgggttggaggctttcgtccaacgccgctcaatcgactttctccgactccgcctggtagcggggaaacacaccggtcggaggcggcagcaccgtacccggagccagccgcgcgcccagcgcgtcgaacgcccgccgatcttggccctgccccagcagatccagcagcttgccggccgattcgggcatgacgggctgcaccagcagcgcggcgatgcggaccacctcgcaggtgacgtacaagacggtgcggaatcgcgtctgatccgcctcggactcgctcttgcgcaacacccacggctgttgcgccgagaagtacttgttggcctcaccgagcatcagccagatcgcttccaggcccaggtgcatcgcctgcgagtcgaaactggcgcgcacccgcggcaacaaaccgtcggccgtctgcagcagttcacggtcgtcgccggtgaagtcaccgggttcgggcaccaccgagtgcaggttcttggcgatcatcgacaacgagcgttgcgccaggttgcccagctcgttggccagatcggtgttgatccgggtgatgatcgcgtcctcggtgtagctgccgtcctggccgaacggcacctcgcgcagcaggaagtagcgcagttggtcgacgccgaaggtgtccaccagcgtgatcgggtcgacgatgttgcccaccgacttgctcatcttctcgccgcggttgagcagaaacccgtgcgcgaaaacccttcggggcagctcgattccggccgacatgagaaacgccggccagtacacggtgtggaaccggatgatgtccttgccgatcatgtgcaaatcggccggccagtagcggcggaacatctccgattcggtgtccgggtatcccaccccggtcaggtagttggtgagcgcgtcgacccagacgtacatgacgtgatcgggatgatcgggcaccttgacgccccagtcgaacgaggtgcgcgagatggacaggtcgcgcaggccgccggagacgaagctgaccacctcgttgcgccgcacctcgggggcgatgaaatccgggttcgcctcgtagtgggccagcagcttgtcggtgtaggccgacagccggaagaaatacgtttgctcctcggtccaggtcagcggggcgccggtttcggcggccacccgcgtcccgtcgtcgagcaccttggtctccgattcgacgaagaaccgctcgtcgcgcaccgaataccaaccggaatagctgtccaggtagatgtcgccggccgcctgcatccgccgccagatcgccttggacgcttcgtgatgatcggggtcggtggtgcggatgaagcggtcgaaggagatgttcaaccgctcctgcagccgctggaacacatcggaattgcgccgggccagctcggccgtgccgatgccctcggccgccgcggtctcgaccatcttgaggccgtgctcgtcggtgccggtcaggaatcgcacgtcgaagccgtcgagccgcttgaaccgggcgatggcatcggtggcgatgtactcgtaggcatgcccgacgtgcgggtcgccgttggggtacgtgatcgcggtggtgacgtagaagggcctcatcgagagtccaccttattgtgtgcgcgtgagctccaaccgacgagaacgacaagccccgcccgccccggagccgctggcgcccctgatcgacgcccacacccacctcgacgcctgcgccgccggaccggagacgggagccgccggcgtgcgggccatcgtggaccgcgcggcggcggtgggggtgcaggcggtggtcaccgtcgccgacgatctggactcggcgcgctgggtcacccgcgcggcggagtgggatccgcgggtgtacgcggccacggcgctgcatcccacccgcgccgacgcgctggacgacgcggcgcgcgccgagatcgagcggctggtggcccaccccggggtggtggccgtcggggagaccggcatggacctgtactggccggggcggctggacggctgcgccgagccggccgtgcagcgggaggccttcgcctggcatatcgatctggccaaacggtgcgggaaaccgctgatgatccacaaccgggaggccgacgccgaggtgctcgacgtgctggccgccgagggtgccccggacctggtgatcttccactgcttctcgtcggatgcggccatggcccgccgttgcgtggacgccggctggctgctgagcctgtccggcaccgtgagcttccgcaacgcccgcgccctgcgcgaagccgtgccgttgataccgcccgggcagctgctggtggaaacggatgcgccgtttttgaccccgcacccgcaccgggggacggccaatgagccctactgccttccttatactgttcgggcgatcgccgaactggtggatcgccgccccgaagagctggccgcggtgacgacggacaatgctcgacgggtgtacggactggcctgacgatcagggccggcgaacgggtgattcttttaacatcgccgcgtcggagttgcccaatattggccggttcgttaccgtcttgtgatcgaacgggtgggcctgcgggcccttcatttgtgaattgccgctgagtgagtggttgctgaggttgggtagcgcgcgttgagtgtattgacaaaacttcatcagaacccttcgccgatgttgcggctcgtggtcggggggctgctggtagtcctggcattcgcgggcggatacgcggtttcggtgtgcaagacggtgacgttgaccgtcgacggtgtcgccatgcgggtgaccacgatgaagtccaaggtgatcgacgtcgtcgaggagaacggcttcgtcgtcgacgaccgtgacgacctgtaccccgccgccgatgtcgcggtgcacgacgccggcaagatcgtgctgcggcgcagccgcccgctgcagatctccctggacggccacgacagcaagcaggtgtggaccacggcctccacggtcgacgaggcgctggcccagctggccatgacagataccgccccggccgcggccaaccgcggcagccgggtgccgctggccggcatggccctgcccgtcgtcagcgccaagacggtgcgcatcaacgacggcggcgccgtgcgcaccgtgcatctggcggcatccaacgtcgcgggcctgctcagcgccgccggcgcgccgctggccgaaagcgaccaggtggcgcccccggcgtcggcgccgatcgtcgacggcatggagatccaggtgacccgcaaccggattcagcaggtcaccgagcggatgccgttgccgcccaacgcccgccggatcgaagacccggacatgaacatgagccgccaggtggtcgaggatcccggcagcccgggcacgcaggacgtcaccttctcggtggccaccgtcaacggcgtggagaccggccggctgccgatcgccaacacggtgatcaccccggcccgcgaatcggtggtgagggtcggcaccaagcccggcaccgaggtcccgccgatcagcgacggctccatctgggacgccatcgcgggctgcgaagccggcggaaactgggcgatcaacaccggtaacgggtattacggcggtgtgcagttcgaccagggcacgtgggagcgcaacggcgggttgcggttcgccccgcgcgccgacctggccacccgcgaagagcagatcaccgtcgccgaggtgacccgagagcgccagggttggggtgcgtggccagtgtgcagcggaagagctggtgcgcgctgaccatccggctcctcgggcgcaccgagatcaggcggctggccaaagaacttgaatttcggccacggaaatccctcggccagaacttcgtgcacgacgccaacacggtgcgccgggtggtgtcgacgtccggggtgagtcgctccgaccacgtcctggaggtcggtcccgggcttggcccgctcacgctggcgttgctggaccgcggcgcccacgtcaccgccgtggagatcgatccggtgctggccgagcggttgccgcacaccgtcgccgaacactcgcacagcgaaatccagcgcctgaccgtgctcaaccgcgacgtgctgacgctgcgccgcgacgagctggccgagccgccgaccgcggtggtggccaatctgccctacaacgtcgcggtcccggccctgctgcacctgctcgccgaattcccgtccatccggacggtgaccgtcatggtgcaggccgaggtggccgaacggctggccgccgagccgggcggcaaggagtacggcgtgcccagcgtcaaggtccgcttcttcggccgggtccgccggtgcggcatggtgtcgccgacggtgttctggccgattccccgggtgtattcggggctggtgcgcatcgaccgctatccgacctcgccgtggcccaccgacccggccttccgccggcaggtgttcgagttggtggacatcgccttcggccagcggcgcaagacctgccgcaacgcgttcgtcgactgggccggctcgggcaacgagtcggcggatcgcctgctggccgccagcatcgacccggcgcgccgcggcgagacgctgtccatcgacgacttcgtccggctgctgcagcggtccgccgatcggggcggaaccgaccgcgagggaaccagcccgccgaccgccggacagggcgccccggcccgctgatcgcgggacgccccgggtcgcgatgcgtgtgcaaggcggccggcagcgatagtctgctgcggtgggtaacgatgtctgacggcaacaccgccgcggcttgggtgcccaccgggtcggtcaccgtccgggtgcccggaaaagtcaacctctacctggccgtcggcgatcgccgcgaggacggctaccacgagctgaccacgatttttcaggccgtctcgctgctcgacgaggtgaccgtgcgcaacgccgacgtgctctcgctcgacatcgtcggcgagggcgccgacaaactgcccaccgacgaacgcaacctggcctggcaggccgccgagctgatggccgaccacgtcggccgggcgccggacgtgtcgatcatgatcgacaagtccattccggtggccggcgggatggccggcggtagcgccgacgcggcggcggtgctggtcgcgatgaactcgctgtgggagctcaacgtgcctcgccgcgatctgcgcatgctcgccgcgcggctgggcagcgacgtgccgtttgcgttgcacggcggcaccgcgctgggcaccggccgcggcgaggagctggcgacggtattgtcccgcaacacctttcactgggtgctggcgttcgccgacggcgagctgctgacccgcaaggtgttcgccgagctggaccggctgcggcgcgcgggcgatccgccgcggctgcccgggccgggcccggtgctggccgcgctggccgccggcgacgccgaccagttggcgccgctgttgggcaatgaaatgcaggccgccgcggtgagcctgaatcccggcctgcgccgcaccctgcgcgccggcgtgcaggccggcgcgctggcgggcatcgtgtcgggctccggcccgacgtgtgccttcctgtgcccgtcggcggccgcggcggtggacgtcggcaccgaggtgtccggggtgggggtgtgccgcacggtgcgggtcgccagcggaccggtggccggtgcccgcgtggtcccggcaccgaccgaggtgtgacacccgagcagcgcggctgtgaaaagagccccaatttcgccattagtttggcgcttccctaagaggagtttaagataatccgcggtgacgggaagcgttgagcagaaacacttaatctcatcgtccgccgggcgttccggcggacgattgatgaatcgggcccgacaaggtttttcgggcccgattcgcgcttgtcggacgaccgggcgccgcgtctttgccgcggccggcgacgcatcaccgatccgagaccgaaccgccgccgaactgtgcttacccgcctgcgtcgcggggtggcccggcgggcggaacatgagatttcgggtgctggggccagggctggaaccgaggaggttttcgtgagcaggtttaccgagaagatgtaccgcaatgcccggaccgcgaagacgggcatggtcaccggtgaaccccacaacccggtccgtcatacctggggcgaggtgcacgagcgtgcccgccgcatcgccggcggcctggccgccgcgggcatcgggccgggtgacgcggtcggcgtgctggccggtttcccggtggagatcgccccgaccgcgcagggcctgtggatgcgcggcgccagcctgaccatgctgcaccagcccaccccgcgcaccgacctggcggtgtgggccgaggacaccatgaacgtcatcggcatgatcgaggcgaaggcagtcgtcgtctcggagcccttcctggtcgccatcccggtcctgcaggagaaggacatcaaggtcctcaccgtcgccgacctgctggcgtccgacccgatcgacccggtcgaggtcggcgaggacgacctggcgctgatgcagctgacgtccggctccaccgggtcccccaaagccgtgcagatcacccaccgcaacatctactccaacgccgaggccatgttcatcggcgcccagtacgacgtcgacaaggacgtcatggtcagctggctgccctgcttccacgacatgggcatggtcggcttcctgaccatcccgatgtacttcggcgccgagctggtcaaggtcaccccgatggacttcctgcgggacaccctgctgtgggccaagctgatcgacaagtacaagggcaccatgaccgcggcgcccaacttcgcctacgcgctgctggccaagcggctgcgccggcaggccaagcccggcgacttcgacctgtcgacgctgcgcttcgcgctgtccggcgccgagcccgtcgaacccgccgacgtcgaggacctgctggacgcgggcaagccgttcgggctcaagccgtcggcgatcctgccggcctacggcatggccgaaaccacgctggccgtgtccttctcggagtgcaacgccgggctggtggtcgacgaggtggacgccgacctgctggccgccctgcgccgcgccgtgccggccaccaagggcaacacccgccggctggccacgctcggcccgctgctgcaggacctggaggcgcgcatcgtcgacgagaacggcgacgtgatgccgccgcgcggggtcggcgtcatcgagctgcgcggcgagtcggtgacgcccggctacctcaccatgggcggcttcatcccggcccaggacgagaacggctggtatgacaccggcgacctcggctacctgaccgaggaggggcacgtggtggtgtgcggccgggtcaaggacgtcatcatcatggccggccgcaacatctatcccaccgacatcgagcgggccgcctgccgtgtggagggggtgcggcccggttgcgcggtggcggtgcgcctggacgccggccactcccgcgagacgttcgcggtggcggtggagtccaacgccttccaggacccggccgaggtgcgtcgcatcgagcaccaggtcgcccgcgaggtggtggccgaggtcgacatgcggccgcgcaacgtggtggtgctgggcccggggaccatccccaagacgccgtcgggcaagttgcggcgatccaactccgtcaccctggtgacttagtcaggcgagcagacacaaaagcacccaaaacatcggcgtgtcgggtgctttcgcgtctgctcgcggttcctgcgctaccaggcgtgcacccggttctgggcgggctcgagccccagttcgatcagcagctcggtggcgtcggcggcctgctcgcagatggtcgggacgtcggcgcgctcggtgctggtgaagttctccagcacgaaggccgccgggtccttgcgccccggcgggcggccgatcccgatgcggacgcgttgaaagtccttgctgcccagggcgtttgccactgagcgcaggccgttgtggccaccctcgccgccgccgatcttgagccggatgcggccgaagtccaagtcgagatcgtcgtggatgacgatgatgtcgcccggcggcaccgagtagaacttcgccagcgggccgacctggcggccggattcgttcatgtagcagcgcggcttggccaccaccacggagcgcccggccagccggccgctgacgatctcggcgccggaccgcttgtgcgccttgaacttcgaacccatccgcgccgccagcaggtcggcgaccatgaacccgacgttgtgccgggtgcgggcgtagttgtctccgggattgcccaggccgaccaccagcaacggctcggccacgatgcgacccgcctactcggactcggcttcggcggcctcttcttcgccggcctcttccgcctcggccgccgcgggctcctcggtgacctcgccagcgccctcctcggcgagttcctcggccgtcggggcgttgaccacgttgaccaccagcaactccgggtcggagatcaggttgacgcccttgggcagggcgatctgcccggcggtgaactgggtgccgggttcggcgtcttcgaccgacacggtgaactgctcgggaatcgagagggcctcggcctcgatctcgatggtgctggcctcctgggtgaccagcgagccgggcgcggcgtcaccctcgatgacgacggtgacctccacgaccaccttctcgccgcggcgcaccaccagcaggtcggcgtgctgaatggtgcggcggatcgggtggatgtcgagcgccttggtcagcgccagctgttccttgccgtcgatgtcgagggtgagcaccgcgttggtgccggcgtgtcgcagcacggccgcgaagtcgtggccggggagctccaggtgctggggatcggtgccgtggccgtagaggacggcggggatcttgccggcgcggcgggcccgccgggacgcgcccttgccggtctcggttcgcaccgcggccgtcagttggttgagtgcttgcttggccatcgtgtcgctcctgtgtgctgttgcgctgtgttcggggcacggccaggacgcgacagtcgtcggtctccgtcgataacggtgctggccagccagccaccctcgccgtgacgcccggccaggttagcgcatgcgcacctcagagcggaaattcggtcttggtgagctgctcggagagcgcccacagcgccgccgccatgccggcatctttggcccgccggctgcgtccgaccggttgggtgcggcccaggtaaccgaaccgggggccgacgaagctgtccccgggcagatcctgggacgccgcgtacagggtttgccgggcgccgaaatcggcgtcggtggcgaccacccgcgtcgccgccgacatcagcgcgtcgcccagcttgcggcccgaggcgccctgcaggttggtgtgcgagtagccggggtgggcggccagcgcgcgcagcggggaaccggcggccgtcaggcggcgctgcagctcgctggtgaacagcaggttggccagcttggactggctgtaggccagccacggcgagtaccggcgcgaccgccagttcagatcctcgaggttgatccgtcccggccagtgcgccatcgacgacaccgtcacgacgcggtcggtgagccggggcagcagcaggttggtcagcgcgaaatggcccaggtggttggtgccgatctggctctcgaagccgtcgacggtcagcgcgtacgggacggccatgatgccggcattgttgatcagcacgtcggccccgctcaccccgtcggcgaaccggcgcaccgacgacagatcctgcaggtcgagttcgcggacctcgacctggccggccatcgtccgcgcggccgcctcgcccttgcgggtgtcgcgcacggccatgatgacggtggccccccgtcgcgccagctcgcgggcggtcaccgcacccaacccgctgttggcgccggtgatgacgacggttcgctgcgcgaacgacggtaggtctgcggcggtccagcctgtcatggctgctaacactaatcgccgcggccgccgggcgccgggcggctacttcgccgccaccacgaagccgtggatgatcgcctcgatgtcggtcgactccgcggcggcctgatcggccaggctggtgatcgtgagctgcaccagatagcgctgatgcgccggcggcgatccggtggcgatgacgatccggttccagctgtgcagccgcatgccgtccaggtcgtagctgccctggatcatcgacgagggaaagccgttgtacggggcgccggacgcgtccagctgcttgaagttctcgaacagctgcgcgtcgtcgttgccgtgcttgatgacttgggccgggtcgaaatcgccgctcagcttgaagaccaccagccgcgccgtggggaacttgccgcccttggagatcatcaccgtctgcgggctgatgttcgggctgctgaacggcgcccagcccggcggggtcgggatcgacaccgtcagatccggcagcgacgccggggccacctgctgcccggtgacaccgatgctctgcagatactgcgacagcgggaccggcttcgccgtggcgctggtggtggtggtcgtcgtcggcgtcttcgacaggatcgattggtagtcgggcggtttcggtgcgcagccggcggtggccacggccagtgcaaccgctgcggcgactgccgcgcagccgcggagtcggttcacagaatctcgcggaccgcgtcgatcgggcgggccagccgagtgcccttcggcgtgacgacgaagggccgttcgatcaggatcgggtgttcgatcatggcgtcgagcaactgctcgtcggacgcctcggccaggttgagctcgtcgtacagcgactcgcgcttgcgcaccgcggtgcgcacgtcgatgccggcgtcgcggatcatcttcaccagttcggcgcgcgacggtggggtcttcaggtattcgacgatgttcggctcgaaaccgttgtcgcgcaacaactccaacgtcttgcgggaggtgctgcagcgggggttgtggtagatggtcgcgccctgagccatctaggcgtccccgtcgaaaagccctgtgaccgaaccgttttcgaagaccgcccggatggtgctggccagcagcggcgcgatggacagcaccgtcagctgcgggaaccgcttttcctcgccgatcggcagggtgttggtcacgatcacctcccgggcgccgcaggaggccaggcgctcggcggccggatcggagagcacaccgtgggtcgcggcgatgatcacgtcgccggcgccctcgtcgcgcagcagcttgaccgcgccggcgatggtgccgccggtgtcgatcatgtcgtcgatcagcacgcaggtccggccggccacctcgcccaccacgcggttggacaccacctggttgggcacccgcggatcgcgggttttgtggatgaaggccagcggcacgccgcccagcgcgtcggcccatttctcggcgatgcgcacccggccggagtcgggggagacgacgaccatgttgccgtcggggtagttgtcgcggatgtagccggtgagcaggttctgcccgcgcatgtggtcgaccggtccgtcgaagaagccctggatctggtcggtgtgcaggtcgacggtcacgatccggtcggcgccggcggtcttgagcaggtcggcgaccaggcgcgccgagatcggttcgcggccgcggtgcttcttgtcttggcgggcgtacgggtagaacggcatcaccgcggtgatccgcttggcgctgccccgcttgagggcgtcgatcatgatcagctgttccatcagccagctgttcaccggtgccggggcggactgcagcacgaacgcgtcgcagccgcgcaccgattcgtggaaccgcacgaagatctcgccgttggcgaactcgcgcgccgtctgggcggtgacgtggacgtcgagttccttggccacctgctcggccagctccgggtgcgcacgaccggagaagagcatcagatttttgcggttatcggtccagtcgtggctcaacgcactgccctcgccatgtcggggtcgagatgaggatcaaaagaaggccccatcgtacgaagcgaatagtacggaaatgtcgccgggttgccagctacccaacccacggtgtctattcggcctccccggcgggacggcccccggcggccttctcggcggcctccgccgctcgcgcggccgcgctgcccgggcgtttgcggcgcacccagccctcgatgttgcgctgcggaccggcggacaccgccagcgcgccgggcggcacatcctcgcgcaccacggtgcccgccccggtgtaggcgccgtcgccgaccgtgaccggggccacgaacatggtgtcggacccggtccgcacgtgtgagcccaccgtggtgcgccgcttggactcgccgtcgtagttgacgaacacgctggaggcgccgatgttgctgtgctcgccgatgtcggcgtcgcccacgtaggtcaggtgcggcaccttggtgccggtgccgatggtggcgttcttggtctcgacgaacgcccccagcttgccgtcgtcgcccagcacggtgccgggccgcagataggcgaacgggccgacggtggcgccggcgccgacggacgacccggtgccgtgggtgcgcaccaccgacgcgccgtcgccgacgctgacgtcggtcagggtggtgtccggcccgacgacacagtggccgccgatctgggtgcggcccagcagctgggtgcccgggtggatgacggtgtcgcgaccgatggtgacgtcgacgtcgatccaggtggtggccgggtcgacgacggtcacgcccgccagctgatgggcggccacgatgcggcggttgagctcggcgcccagctgggcgagctgcacgcggttgttgacgccggccaccagcgcactgtcgtcgacgtggcgggcgcggatgggcaggccgtcgccgcgcaggatcgcgatgacgtcggtcaggtacagctcctgctgggcgttgtcggcgctcaaccggttcagcgccgagcgcaacgccgccgtgtcgaaggcgtacaccccggcgttgacctcgcggatttcgcgttgcgattcggtggcgtcggcgtgctcgacgatcgccgtcacctcgttgtcctgggtgcgcaggatgcggccgtagccgctggggtcgctcagcgtcgtggtcagcacggtgaccgcggcccgggtcgcggtgtggccagcgatcaggtcggccacggtgtcggcgtccagcagcggggtgtcgccggaggtgacgaccaggacgccggcgtagtcgtcgggcagcgccgacaggccacaccggacggcgtcgccggtgccgcggggccgttcctgcagcgccacgtcgatggggcggcccaggtcgtcggcccaatcggcgatcagcggggcgatgcgctcgtggtcgtggcccagcaccacggccaggtgttgcggcgccaccttggcgatggcgtgcagcagatgggacagcatgctgcggccgccgagcgggtgcagcaccttcggggtgtccgaccgcatccgggtgccgggcccggccgccagcaccaggaccgcggtatcaccaggagacgacatcgaccctcctcaaaccccggcgcgacggtgcccgtcggtgcgacgacacgccgtcaagcgtggcacttgcggcacgctcgaggcaaaagggctcgtgcctgttggtgctccgtcgccaggactcgaacctgaactctcagaaccaaaatctgatgtgctgccgattacaccacgacggatcgccgggcccctagggccgcgccaacccaagactttagacgctgcgggccgatcgcggcgccgcgggaaagacgggcggcgcggcgcgggcgacgctatacgctgattgacgtggccgtgctggactcgcaaacccacaaggacccggacaaggaggtgcgggcgccgcgcgcgcggatgaccggcagcgagcgccggcagcagctcatcggcatcgcgcgctcgctgttcgccgaacgcggctacgagggcacctcgatcgaggagatcgcgctgcgcgccaacgtgtccaagccggtggtctacgagcatttcggcggcaaggagggcctgtacgccgtcgtcgtcgaccgggagatgtcggcgttgctggacggcatcacctcgtcgcttaccaacaaccggtcccgggtgcgcgtcgagcgggtcgcgctggcgttgctcacctacgtcgaggagcgcaccgacggcttccggatcatgatccgcgactcgccggccgcgatcagctcgggcacctactccagcctgctcaacgacgccgtcagccaggtcagctccatcctggccggcgacttcgcccggcgcggcctggaccccgacctggcgccgctgtacgcccaggcgctggtgggttcggtgtcgatgacggcgcagtggtggctcgacacccgcgagcccaagaaggaagtggtggccgcccacctggtcaacctgatgtggaacgggttgacgcatctggaagccgacccccggctgcaagacgagtgagcgttccgcgggtgtaacgccacggcggtctccggccggattcggccgccgtggcgttacgagcggcgagccggggctacccgcggtcgcgggccagcaggtcggccacggtttcgcggcggaccagttcccgggcccggccctcgctgaccgccaccagcggcgggcgcccgaccatgttgtagttcgacgccatgctgtggtggtaggcgccggtgcaggccacggccagcaggtcacccgggcgcagatcggcgggcagctcgacgtcgcgggcgatctcgtcgccggactcgcagtgccggcccgccaccgtgacccgctgcttgaggcccagcggatgccggttggccagcgcgacggcataccgcgcgccgtacagcgacacccgcgggttgtcgctcatgccgccgtcgacggcgacgaaggtccgcccgccgccttgcgtcttcaccgagcacacccggtacagggtcaccccggcccgaccgctgatcgcccggcccggctccaccacgatctgcgggcgggggaaccgctcggcggcgcacgcctcgtccagggcgtcctcgatcacgtcggccagctggtcgaggttcagctccgggtcgccggacgcatacggaatggcatgtcccccaccgatattcagctcggtcaggatgacgccgtgccgggcccggatatcggccatcgcggcgatcatccggcggatcgcctcgccgtacagggcggggtcggacacctgcgagccgaggtggcagtgcaggccgaccaggtcgaggatggggtgggccagcacccggcgcaccgcgtcggccgcgtggtcgccggccagggtgaagccgaacttctggtcgctgacgccggtggtgacggcgcgatgcccgtggatgtcgatgtcgggggtgacccggatgagcaccggctggcggcgacgggccaggccggccagatacgcgatctcgatggtcgaatccagcacgatgcggcccaccccgacgcgcaccgcctcgcgcagctcctcgggcgatttcgcgttgccgtgcatgacgatgcgggccgggtcgaccccgccggccagcgcggtggccagttcaccggccgagcagacgtcgacgccgaggcgctcctcgcgggcccaccgggccaccgcggtgctcagcagggacttgccggcgtagaccacctcgacgccgcgcagcgccctgcggtaccggcgggcgcggcaccggaagtcggcttcgtcgacgacgtaggccggggtgccgaactcgtcggcgacgtcgcccagcggcacgccgccgacgcacagccggccctcctcgtcgggatgggcggtgacgggccagatcgccggatcgaaccgtgggggagccgcgtgacccagcgacggcaggatgtccagcaatgtcatgcatccaacctgcgcgcgcggggcgccggccggtgcgtttcttacgctcccttgacggcgacgagctcaatattgacgtggttcgcccgcgtccggcggtcccgcccggcggcggcgagcgccgcgtcggcgggagcagggagccgggcgcgccgccctagaatggaattcatcatgaccgcaccgggggctgctcgcccagaaaccccgatcgcggggctcgttgaattggcgctcaccgcgccgaccttccagcagttgatcgacaccgcggccgcatcgccggccgacctgagcctggtgggtccagccagcacgcgactgttcgtcgccagtgcgctggcgcggttgggccctttgctggtagtcaccgcgaccgggcgcgaagccgacgacctgaccgctgaactgcgcggcgtcgtcggcgatgccgtggccgtcttcccgtcctgggagacgctgccgcacgagcggctctcgcccggcgtcgacaccgtcggcgcccggttgacggtgctgcgccggctggcccaccccgacgacgcgaggctggggccgcccctgcaggtggtggtgaccgcggtccgctcgctgctgcagccgatgaccccgcagctgggtctggtggagccggtgacgctgagcgtgggccaggagatcgaattcgagcacgtgatcgcgcggctggtcgagctggcctacagcagggtcgacatggtgggccggcgcggcgaattcgccgtgcgcggcggcattctcgacgtcttcccgccgaccgccgagcacccggtgcgggtcgagttctggggtgacgaggtcagcgagatgcggatgttctcggtcgccgaccagcgttccatccccgagatcgcggtcgacaccgtgatctcggtgccctgccgcgagctgctgctcaccgaggacgtgcgggcccgcgccgcggagctggccgcccagcacccggcgagcgagccggccatcaccggcagcgtcagcgacatgctggccaagatcgccgacggcatcgcggtcgacggcatggaggcgctgctgccggtgctgcggcccggcaagcaggtgctgctgaccgatcagctggccgatcgcaccccggtgctgctgtgcgacccggagaagatccgcacccgggcggccgacctgatcaagaccggccgcgagttcctggaggcctcctggtcggtcgcggcgctggggaccttggagaatcaagcgccgatcgacgtcgagcaactgggcggatcgggcttcgccgagctggacgaggtgcgggcggcggcggtccggggcgggcacccgtggtggacgctgagccagctgtccgacgagtcggcggtggagctggacgtgcgggcggcgccgtcggcgcgcggccatcaacacgacatcgacggcatcttcgcgatgctgcgcgcgcacgtcagcaccggcggccacgccgccgtcgtcgcgcccggcaccgggaccgcgcaccgggtggtggaacggctggccgaatgcgacaccccggccgccatgctggaatccggcgcggcgccccgcgccggggtggtcggggtgctcaagggaccgctgcacgacggcatcgttatccccggcgcgaacctggtggtgatcaccgagacggacttgaccggcagccgggtcgccgccgtggagggcaagcggctggcggccaagcggcgcaacaccgtcgacccgctggcgctgacggccggcgacctggtggtgcacgaccagcacggcatcggccggttcgtggagatgaccgagcgcacggtcggcggggcgcggcgcgagtacctggtgctggagtacgcgtcgtccaagcggggcggcggatccgacaagctttatgtcccgatggattcgctggaccagctgtcgcgctatgtcggcgggcaggcgccggcgctgtccaaactcggcggcagcgactgggccaacaccaagaccaaggcgcgccgcgcggtgcgcgagatcgccggcgaactggtctcgctgtacgccaagcggcaggccagccccgggcacgcgttctccccggacaccccgtggcaggccgagatggaggacgccttcggctacaccgagaccgtcgaccagctgaccgcgatcaccgaggtcaagtcggacatggaaaaaccgatcccgatggaccgggtgatctgcggcgacgtcggctacggcaagaccgagatcgcggtgcgggcggcgttcaaggcggtgcaggacggcaagcaggtcgccgtgctggtgcccaccacgctgctggccgaccagcatctgcagaccttcaccgaccggatggccggcttcccggtgaccgtgaagggcctgtcccggttcaccgacgcggccgaatcccgcgcggtgatcgaggggctggccgacggctcggtcgacatcgtgatcggcacgcaccggctgctgcagaccggggtgcgctggaaggacctcggcctggtggtggtcgacgaggagcagcggttcggcgtcgaacacaaggagcacatcaagagcctgcgcacccacgtcgacgtgctgaccatgagcgccacgccgattcccagaacgctggagatgagcctggccggcatccgcgagatgtcgaccatcctgaccccgccggaggagcgctacccggtgctgacctacgtcggcccgcacgacgacaagcaggtggcggcggcgttgcggcgcgagctgctgcgcgacgggcaggccttctacgtgcacaaccgggtcagctcgatcgaccgggcggcggcccgggtgcgcgagctggtgcccgaggcgcgggtggtggtggtggtggcgcacgggcagatgcccgaggagcggctggaacgcaccgtgcaggggttctggaaccgcgagtacgacatcctggtgtgcaccacgatcgtggagacagggctggacatctccaacgccaacacgctgatcgtcgagcgcgccgacacgttcgggctctcgcagctgcaccagctgcgcggccgggtggggcgcagccgcgaacggggttacgcctacttcctgtatccgccgcacgccccgctgaccgagacggcgtatgaccggctggccaccatcgcccagaacaacgagctcggcgcgggcatggcggtcgcgctgaaggacctggagatccgcggcgcgggcaacgtgctgggggtggagcagtccgggcacgtcgccggcgtcggcttcgacttgtatgtgcggctggtgggcgaggccgtcgaggcgtaccgggccgcggcggacggccagaccgtcaccaccgccgaggagcccaaggacgtgcggatcgacctgccggtggacgcgcacctgccgccggactacatcgccagcgatcggctgcggctggaggcgtatcggcggctggccgccgcgggctcggacgacgagatcgacgcggtggtcgaggaactcgtcgaccgctacggggcgctgcccgaaccggccctgcggctggtggcggtcgcccggctgcggctgctgtgccgcgccgccggcatcaccgaggtgtcggcgccgtcggcggccaccgtgcggctgtcgccgatcacgctgcccgattcggcccaggtgcggctgaagcggatgtatccggccgccagctaccgggccaccacgtcgaccgtgcaggttcccatcccgcgcgccggcggggtgggcgcgccgcggctgcgtgacgtcgagttggtgcagatggtggccaacctggtgacggcgctgcagggtaaaccgcagacggatgtcggcaccggcacgccggtggcggcgatggccagtgaggaggggcgcgggtgattgtgatcttgtgcgacccgcgccggccgtcgctggtgccggtcgaggccgtcgagcatctcaccggcgaggtgcagtacaccgaggagatgccgatcgcggtgccctggtcgctgccggcggtgcgcccggtgcactccggcgaccccgatgatccggcgccggtgctgctgtcgtcggaccgcgaccaccccgccgtcaccgcccggctggccgccggggcgcggctgatctcggcgccggacgccccgcgcggcgaacggctggtcgacgcggtggcgatgatggacaagctgcgcgccggaccgtgggaaagtgagcaaacccacgagtcgctgcgccggtttctgctggaggagacctacgagttgctggacgcggtggccggcggcaacgccgaggcgttgcgtgacgaactcggcgacgtgctgctgcaggtcctcttccacgcccgcatcgccgaggacgccccgcagtcggccttcaccatcgacgacgtcgccgccgcgctgatccgcaaactgggcaaccgggtgccgggagtgcttgccgggcaaaccatttcgctcgaagagcagctggcgcagtgggaagagcgcaaggcggccgagaagccgcggaaatcggtgatggacgacgtgcacaccgggcaaccggcgctggcgctggcgcagaaggtgatcgggcgggccgagaaggccggtctgcccgccgacctgatcccgccgcaggtcacctcgatcgcaatatcggccgacgtggacgctgaaagtgctttgcgcacagcggttttggatttcgtggcaaccgtccgcggtgtcgagcgctcgatcgcggcggcgcgccgcggcaccagtgtccccgacgagttcgacatcgccccgctcggtgagatctccgagcaggagtggcggcagcactggccggcgggcgacaccgatcccgagccggcccccgccgagcagctcaccgacgacgccggcggcgacgagaactgagcggccggtcccgttggccgtcggcccgtggcgtgttcaccgccgccgagagcgatcaccgcattgtttgccggatttggcgtccgcgcctcggtaatatcggggatgaggttgcgaatccccgtggtcggcctcggtctgaccgcgctagccaaggtgaccgtcagctaatcgacgattagctgaacgcggcgacaaatcggtgcccgcgggcccggcgcaaccgagcggtcccggaatgcatgggacgatggtggggcggaagttggtgcaggcgagttttaggggagctcaggaaagcatggtgtcgccgaggcgttggatgcgcgcggccgccgtgatcggcgcgaccgcgatcgtgctggcctccagctgcacctggcagctcagcctgttcatccccgacggcgtcccgccgccggccggcgacccggtgcccccggtggacacccacgccagcggtcgacccgcggatcagttgcgcgactgggccgcgcagcgcgcggccggattggagatcccggtcatcgcgctcgaggcctacgcgtacgcggcgcgggtcgccgaggtcgagaacccgaagtgccacatcgcctggaccacgctggcgggcatcgggcaggtggagagccaccacggcacctaccgcggcgcgcggctggcgcccaacggcgatgtgagccccccgattcggggtgtccgcctggacggcagcggcggcacgctgcgcatcgtcgacaacgacgaggacgtcacggacgaggacggcgtgacgcgcgcgatggggccgatgcagttcatcccggagacctggcggctctacgcggtcgacgctcacaacgacggccgggtcagcccggacaacatcgacgacgccgcgctcgccgcggcgggttatctgtgttggcgcggaaaggatctcgccacaccgcgcgggtggatcaccgcgctgcgcgcctacaacaactccggtgtctacgcccgggcggtgcgcgattgggcgaccgcttacgccaaaggtcacccgctgtagcaggatgtatcgctgacgacgagtgcacgcaccggctacggatacaaggagaactcagtgccgattatcgagcaggtcggggcccgcgagatcctcgactcccgcggtaacccgacagtcgaggtcgagatcgccctgaccgacggaacgttcgcccgcgcggcggtgccgtccggggcgtcgaccggtgagcacgaggccgtcgaactgcgcgacggcggggagcggtacggcggcaagggcgtgcagaaggcggtgcaggccgtgctggacgagatcggcccggcggtgatcgggctgaacgccgacgaccagcgcctggtggaccaggcgctggtcgacctggacggcaccccggacaagtcgaggctgggcggcaacgcgatcctgggcgtgtcgctggccgtggccaaggcggccgccgattccgcggagttgccgctgttccgctacctgggcgggcccaacgcgcacatcctgccggtgccgatgatgaacatcctcaacggcggcgcgcacgccgacaccgccgtcgacatccaggagttcatggtcgccccgatcggcgcgccgagtttcgccgaggcgttgcgctggggtgcggaggtgtatcactcgctgaagtcggtgctgaagaaggagggcctgagcaccggcctgggcgacgagggcggcttcgcccccgacgtggcgggcaccaccgcggcgctggacctgatcggccgggccatcgaatcggccggcttcaaactcggcaccgacgtggcgctggccctcgacgcggcggccaccgagttctacagcgacggcaccggctacaagttcgagggcagcacccgcaccgccgagcagatggccgagttctacgccgggctgctcggcgcgtatccgttggtgtccatcgaagacccgctgtccgaagatgattgggacggctgggcggcgctgaccgcgtcgatcggcgaccgggtgcagctcgtcggcgacgacgtcttcgtcaccaatcccgaacgcctggaagagggtatcgagaagggcgtcgcaaatgcgttgctggtcaaggtgaatcagatcggcacgctgaccgagacgctggacgccgtcgcgctggcccaccacagcggctaccgcacgatgatgagccaccgcagcggtgaaaccgaggacaccacgatcgccgacctggcggtggccgtcggcagtgggcagatcaagaccggagcgccggcccgcagcgagcgggtggccaagtacaaccagctgctgcggatcgaggaggcgctcggcgacgccgcgcgttacgccggcgacctggccttcccgcggttcgcgttggagaccagatagcttgcccgccaagcccgatccgaagcgccgctccccggcatcgcggccggggaaagccggcgattcggttcggcgccgtcgcgcggccaagccgtcgcagaccgtcaccgcccgcaagaccgcccgggcgcggcacgagccggcggccgaacccatcgtgcggcaggccgccgagtcggtggagcagcgctccgagcagcggctgggtttcaccgcccggcgcgcggcggtgctggccgcggtgatctgcgtgctgacgttgaccatcgccgggccggtgcgcacctatttcgcccagcgcaccgagatgaatcagctggccgccagcgaggcggcgctgcgccgccagatcgccgacttggagcagcgcaaggccaaactcgccgacccggcctatatcgcggcccaggcccgcgagcggctcggcttcgtcaaacccggcgacatcccgttccaggttcagcttccgccgaccgccgccgaacccacccagccgggatcgccgtcggcgaagccggtcaacaacgacccgtggtacacctcgctgtggcacaccatcgccgatgctccgcacctgccgccggccaatcctgctgtcccgcaagccccgccggccgaaccgggtccgcccggtccggttccgccgcccgcaccgaatcccgcgggtcccggtggttgatcgcgccgacctggatgcggtggcgcgtcaactcgggcgtgaaccgcgcggggtgctcgccatcgcctatcggtgtcccaacggcgaacccggtgtggtgaagaccgcgccgaaactccctgacggaacaccgtttccgacgctgtactacctgacgcatcccgcgctgacggcggccgcgagcaggttggagacgacggggttgatgcgggagatgaccgagcggctgagtcaggacgcggaattggcggccgcgtaccggcgtgcccacgagtcgtatctggccgaacgggacgcgatcgaacccctgggcaccacgttttcggccggcggcatgccggaccgggtcaagtgcctgcacgtgctgatcgctcattcgctggccaaggggccgggcgtgaatccctttggggaccaggcgttgtcgatcctggccgccgatcccgcgctggccggagttttacaggagggccgatggtgaccggcaggctcgcgggaatcgactgcggcaccaactcgatccggttgctgatcgccgacgtgcgcgacggccggctgcgcgacgtgcaccgggagacccggatcgtgcggttgggtcagggtgtggacgcgaccggggagttcgcgccggaggccatcgcgcgcacccgcgcggcgctgagcgactacgcggatctgctgaaacaacatggtgtgcagcgggtgcggatggtggccacgtcggccgcccgggacgtcggcaaccgggccgacttcttttccatgacggccgacgtgctgggcgcggtgctgcccggtgcggtggccgaagtgatcaccggcgccgacgaggccgagctgtcgttccgcggggcggtcggcgaattggacagtgcggccggtcctttcgtggtcgtcgacctgggcggcgggtcgacggagatcgtggtcggcggcagtgacggggtgacggcgagccactcggccgacatcggctgcgtgcggctgaccgagcgatgcctgcattccgacccgccgacgcccgaggaggtggcgctggcccgtcaggtggtgcgcgaacggctcgaggtcgcgctgggggtggtgcccgtggaaggggcgcgaacctgggtcggggtggccgggacgatgaccacgctgtcggcgctggctcacgatttgcccgcgtatgattctgcggccattcatctttcgcgggtgagcgggcgggatctgctggcggtgtgcgaacggctgatcggcatgacgcgggcccagcgcgcggcgctgccgccgatgcacgcgggtcgggccgacgtgatcgccggaggcgcggtcgtggtggaggaactggcgcgggagttgcgtgcccgcgcgggcatcgacgagctgacggtcagcgagcacgacatcctggacggcatcgtgctgtccatcgcggggtaggccacttcggtcacggacgtctccgctggaggtccctcacggatgtccctgctggaggcgaggtgttaagtgcccgcctctgagcgacaaccggggatgtcacacccgtgtgggacggttcggcgatgaatcgactactactcaagggcatagagctgcgctatgtgctggcgatgcagttggccgtgcacggaccggccgacatcggcgagctgatcaaagcgcttgactggcatggtttttgcgtgcagggccggccgtcgaaggcggtgtcggatgcgctgcgttgggagatcgtgcatgggcgggtacgccggctcggccggggccgatacggcccgggcggcatgccgcgctccaccgaacaccgaatccatcagcgtgtcttggccctgcgtgaggcggcccgttgtcgctgtgaggcgggcacttaaccgattgcccggcgcggggacgcgagtggccggtggggctggcgaggcggtagtgccggccgcggccccgcaccgcgatcgcctcgctcacgcctcgaatcgataccccatgcccgattcggtcagcaggtgtttggggtgcgacgggtcgttttccagcttgcggcgcagctgcgcgagatacacacgcaggtaatgggtttcggtggcatacgccggcccccagacctccttgagcagctcctcgcggccgaccagcttgccccgattgcggaccaggacctcgagcatcccccactcggtgggggtgaggtgcacctcgctgccgttcttggtgaccttcttggcggccaggtcgacggtgaacgactccgtttcgacgaccggctgttccatctcggaggccgcggtgttgcggcgcactgccgcccgcagccgagccaggaactcgtccatcccaaagggtttggtgacgtaatcgtcggccccggcgtccagcgcttcgaccttgtccgacgaatcggtgcgggcggacaacacgatcaccggcgcggtgagccaaccgcgcagccctgccagcacgtcgatcccggagatgtccggcagcccgaggtcgaggatcaccacgtcgggtttgtgctcggcggcggcccgtagcgcgccggcgccggtcgacgcggtgaccacctcgtacccgcgcaccgacaggttgatgcgcagcgcgcgcaggatctgcggctcgtcgtcgatcaccaaaacgcgagtcatctgcgccgctcctcagcatcgctgcgctctgcatcgtcgccggcgcgcgtcatgcggcgccttcggattgcggcgcagccatatccaccatcaccgtgagcccgccgccgggagtgtcggtggccgtgatcgtccctcccatcgcctcgacgaagccgcgcgccaccgacatgcccaaccccaccccggtggtgttgtcgtgatcgccgagccgctgaaacgcttcgaagatctgttcctcggcgccgtgcggtatcccgggcccttcgtcgatgacgctgatcagcacccgatcgccgacctgcccggcgttgacccgcaccacacagttgggcgcgtagcgcagcgcgttgtcgatcaggttggccagcacccgctccagcagcccggcgtcggccatcaccatggcatcgcccacatcgaccttgaccctatcgatcgcggagcggaagaagccggtggcgcccttgccgatgctgaccagcgcgcgttgcacggcctcctccagatacacccggcgcaggtccgggtgaatcgccccggcggccagccgcgacgaatcgagcaggttgcccaccagcgcggtcagctggtcgatcgactcctcgatggtggccagcaactccgcggtgtcggtgggggagaaggcgacatcctcggcacgcaggctggagaccgccaccttggccgccgccagcggggtgcgcaggtcgtggctgaccgccgacaacagcgagcggcgcagctcgtcggcccgcacgatcgcctcggtgcggctggcctcctcggcgagttcgcgctgccggatcagccccgccgcctgccgggccacggcgctgagcacccggcggtcccgcgcggacagcttgcggcccgccagcagcatctgaaattcgctggaatcggggccgcccacctcgatcgcggtgtccgcggcgtcgacgctgacacagggatcccggcccacgcaggcaaccacctgggtcttggtgccgccggcccgcgcgtcctccgactcgcgcagcatgctgaccgaccgctgggcgtaggtctcgcgcacccgctccagcagcgtctccagatcggcgccgcgcagcaccgaacccgcgaacagcgtcagcagctcggcctcctgggaagcgcgccgggcctcccgggtgcgcttggccgcgaagtcgaccagcaccgcgaccgccaccgcgatcagcagcagcaccaattcggtgatggcactgttgggttcggcgatggtgaagctgtgccgtggggcgatcaggtagtagttcagcagcagcccggacagcaccgccgaaagtgccgccggcgcaatgcctcccagcagccccaccagcagcaccccgacgaagaacagcgcgctctcgccgccggtgtccaggtaggggtccagccacgtgacggtgaccgcgcagatgaccgacggcacgatcagcgccgccagccaggacgccacccgccgctcccgcggcgccagcgaggacgcccggaagccgcgtttggattcctcgtgggtgaccaggtgcacgtcgatcttgccggacaattcgacgatccgcgggccgatcccctcctcgaacagccgcgcccagcgggaccgccgcgaggtgccgatcaccagctgggtggcgttcatctcgcgggcgaactcgagcagggccgcgggcacctcgtcgccgacgatggtgtgcagcgacgcgtccaggctgctggcgagctcccggatcttggccatccgcgattccgacaggccggccagcccgtcgccccggatgacgtgcaccaccatcagttcggcgctggacttcgacgcgatgcgcgacgcccgtcgcaccaacgtctccgattccggaccgccggtgaccgccaccacgacccgctcgcgggcctcccacgtgtcggtgatcttgttctcggcgcggtatttggccagcgccgtgtcgacctggtcggccagccacagcagcaccagttcccttagcgcggtgaggtttccgcgccggaagtagttggacagcgccgcgtcgatccgatccggcgcatagacattcccatgagacagcctgcgccgcaacgcttccggtgtgatgtcgatgagctcgacctgcgaggcctggcggacgaccgaatccggcacggtctctttctgctcgatgccggtgatctgggcgacgacgtcgttgaggctttccaggtgctgcacgttgacggtggagatcaccgtgatcccggcgtccagaagctcctcgacgtcctgccaccgcttggggttcttgctgcccggggtgttggtgtgtgcgagttcgtcgaccaacaccacctgggggtgacgggccagcacggccggcacgtcgagttcggggaagcggccgccccggtattcgatgtagcgcggcggaatgatctcgatgccctcaagcagctcagcggttttcgcgcgcccgtgggtctccaccaccccggccaccagatccgtgccgcgctccagccgccgatgtgcctcacccagcatggaatacgtcttgcccacccccggggccgcacccagatagatgcgtagttccccgcgcttgggatggtggtcgcggacgtcggtcacgtcaaccatcatcccccctcgccgctagctggtgaccggatagcggtggtcgagttgcagatttagctgcagcacgttgacgcacggttcaccgaaaaagcccagcgcgcgcccgctgctgttctgcgccaccagctcccggatctgctccgggcggacgtggcgcaccttggccacccgcgccacctggatgtcggcgtaggccggcgagatgttcgggtccaggccgctgccgccggcggtgaccgcgtcggcgggcacggccggggccgccggtgccgctccgcggatgggcacgatctggccgagcgaatagtcctccccggtcttggcgcattcgacgcgcaccccctcgtagaggctcacgaacggtgtcggggtcgattcgcacggttcgttgacgctgaccacccgggccgggtgggtgacgttgccgcgctcgtcgcgcggcccgatcaccgacagcaccgcccccacaccgccgccggtgcagaacggccgcgacccgtcgacgccctccagtttggcgacggcggcgctgcgcgagcacaccgtggtcagcaggccgggtttgccgggtgcgtcgacgatgctctccggccccaggttgctgccgccgctggaggtcgggtcgtagccggtgccggccgccgaggggcgactctgaaagtactgcggcagcgggttgccgtccttgtcggtgaacagctggccgatcagtctgctgcccaccggcttgccgttggcggtcaggatcgacccctcggcgtggtcgcgtaatccggggaactgcgccaccacccagacgagcagcggataggccaggccggtgatcacggtcagcaccagcagcgcccgcaacgccgcccagtgcaggcgaatgaagttcgacagtgtcatgtcaggacatcccggggacgaattggacgatcaggtcgatcgccttgattccgatgaacggggcgacgatgccgcccaggccgtagatatacaggttgcggctcaacagctttgacgcgctgctcggcgtgtaccgcacaccgcgcagcgacagcgggatcagcagcacgatgatgatcgcgttgaagatcaccgccgacaggatcgccgactgcgggctgtgcagccgcatcacgttgatcagatccaggccggggaacagcgcgacgaacatcgccgggatgatcgcgaagtacttggcgatgtcgttggcgatcgagaaggtggtcagcgccccgcgggtgatcagcaattgcttgccgatctcgacgatctcgatgagcttggtggggtcggagtcgagatcgaccatgttgccggcctctttggccgccgacgtgccggtgttcatcgccacccccacgtcggcctgggcgagggcgggcgcgtcgttggtgccgtcgccggtcatcgccaccagcttgccgccggcctgctcccgcttgatcaattgaagcttgtcctcgggggtggcctcggcgaggaagtcgtcgacgccggcctcgtcggcaattgccttggcggtcaatgggttatcgccggtgatcatcaccgtccggatgcccatccgccgcatctcgtcgaaccgttcccgcatgccctgcttcaccacgtccttgaggtggatgacaccgagcacccgtgcccggccgtcgacgctctcgccgacgaccagtggtgtgccgccgccggcggagatgccgttccacgatctcgccgagctggtgcgggacgctgccgcgttggctgcgtacccattcggctaccgaactggccgcccccttgcgcagggagtgcccgtccaggtcgacccccgacatccgggtggtggccgagaacgccacccactgcgcctgggacagctcgccgggggtgcgcgcccgcaacccgaagtgctgcttggcgaacaccacaaccgaacggccctcgggtgtttcgtcggccaggctggacagctgcgcggcgtcggccaactcctcggggggcacgccggccagcgggatgaaggcggcggcctgccggttgcccagcgtgatggtgccggtcttgtccagcagcagggtgttgacgtcaccggcggcttccaccgcccgccccgacatggcgagcacgttgcgctgcaccagccggtccatgccggcgatgccgatggccgacagcagcgccccgatggtggtcgggatcaggcacaccagcagcgacaccatcacgatgccggtgacgccacttgtgttgagcgcctgggtatccgggacgcccgggttgttcaccttcgagtagatggccagcggctgcaacgtggcgacggcgaacacgaagatgatcgtcagcgcggccagcaggatgttcagcgcgatctcgttgggtgtcttctgccggttggcgccctcgacgagggcgatcatccggtcgatgaagctttcgcccggcttctgggtgatctgcacgacgatgcggtcgctgagcacggtggtgccgccggtgaccgccgatcggtccccgccggactcgcggatcaccggtgcggactcgccggtgatggccgattcgtccaccgacgcaatgccttccaccacatcaccgtcgccggggatcacctgcccggcctccaccacgacgatgtcgccctgttgcagcgcggtggcggagacggcctcctcgatcccggtcgagccgggcgcccagtcgcgcaggcgccgcgccatggtctgggttttggcccggcgcagggtttctgcctgggccttgccccggccctcggccaccgcctcggcgaggttggcgaacagcacggtgagccacagccagatcacggtcagccaggcgaaccaggtcgggccgacgatcgccaacaccgtgctccacgccgcgccgatttcgacgatgaacatcaccgggttgcgccacagcgtgcgcgggtcgagtttgcgcagcgcgtccggggtggagcgccacagcatcttcgggtcgagcaggccgccctgcacccgcttggtgccggccgacggcgccggatgcgcctgctcggccgggtcgatcgcggtcacggtcatcagtggattccttcggcgagaggcccgagcgcgagcatgggcaggaacgtgagggcgacgacgatcagcgtgacgcccgcgaccatgccgacgaactggggccggtgggtgggcagggtgcccgccgagtccggggtgctgccctgcctggccagcgatccggccagcgccagcaccagcacgatgggcaggaaccggccgaacgccatggccaggccgagggccgtgttgtaccactcggtgttggcgctcagtccggcgaaggccgacccattgttgttggccgccgaggtgaacgcgtataacacctccgacaaaccgtgcggaccgctgttggccatgccggcgcgttcaccgggcagcgccatcgcgatcgcggtgccggtcagcacgatcagcggcgtgaccaggaaatagcttgcggcgagcttgatttcgcgcgggttgatcttcttgcccaggtactccggggtgcgcccgaccatcagcccggccacgaacaccgtgatcaccgcgagcaccagcatgccgtacaggcccgagccggtgccgccgggcgccacctcacccagctgcatgttgaacatggtgatcatgccgccgaggctggtgagcgagtcgtgcgcggagtccaccgcgccggtggaggtgagcgttgtcgccgcggcgaacacgcccgagtcgggaacgccgaaccgctgttcgacgccctccatcgccgcgccgaccgcgctgggcaccgtgccgtgatgctgcagctggaaccacagcatgaagccggtgctcagcaggtacagcgacgccatcaccgacgcaatcgcgtagccctgcttggggttacccaccatccgcccgaaggtgcggggcaacgagaagccgatcaccaggatcaggaagacctccagccagttggtccaggcggtcggattctcgaacgggtgcgcggaattggcgttgtagaagccgccgccgttggtggcgagttccttgatcacctcctggctggccaccgggccgccggggatggtctgtgcggtgccgcccagcgtggtgacgacctggtcgtgcagatggaagttctggatcgccccgccggcgaccagcagcacggcgccgacgatcgagatgggcagcaggatgcgcagcgtcccgcgcaccaggtcgacccagaagttgcccagctcgccggtgcgccgacgggcgaacccgcgcaccagggcgacggccaccgccatgccgacggccgccgagacgaagttctgcaccgccaagccggccatctgcaccaggtggccctgggtggtttcccccgagtacgcctgccaattggtgttggtgacgaagctgaccgcggtgttccacgccagcgagggcgtcatcttggtggccgggtcatgcaggtgcagcggtagtttgccctgcaccagctgcagcacgaacaggaaaatgatgctgaccgaggagaacgccaacacaccgcgggcgtaggcgccccaggtctgttccgagcgcgcgtcgacgccgatgagccgatagatcgttcgctcggtggcgaggtccctgtcggtcgtgtagacacgaaacatgtagtcgcccaagggaacatggaccgcgaccaacgccgcgacgaggacggcgagaaagatcagtcccgcggttgtgctgctcacctagaacctctccgggaacaacagcgcgcccgcgagaaagagcgcgatgagaatggaaagcaccaagccgaccgtgttttggtagttcatagccgttcgaccagcttctgggccacgccgagcgccgcgaacaccgccacggtcagcaccagatacaccaccacgcccatcctgtctccgttccgcgccgatcacctgcatacgaaaagggctccgtcgagccggcccgaagcggggctctcgaggcgaagtcagcttgaaattaatcgggcccgggctgccagggcctttggttgacggtttcctaacggggccgtagtgcacctttacggtttgttaacgccccttgcggtggggccgtcaaagacccgctacgccaagggttcccggtccgccgatcagcgggagccggacccggaacaccgtcctgcccgcggtggattcgacgcccaccgagccgtggtgggccttgacgatcgagctgacgatggccagccccagcccgtggcccgagccgtcggacctcgacttgtcggcccggacgaaccgctcgaacaggttgggcagcaggtccgcgtcgatgccggggccgtcgtcggtgacggtcagctcggcgaacggcgcctcgcggccgccgcggtgacagcggatcgcggtcgtcaccgtgaccccgggcggggtgtgcacgcgggcgttgccgagcagattgctgaccagctgatgcagtcgggcctggtcgccgcgcacccagaccggttcgtccggcaggtctttgacccagtggtgggtgggggcggccaccatcgcgtcgttcaccgcgtcgctgaccacctcggtcaagtcgacgtcctcggactgcaggtcctggccctcacccagccgggaaagcagcagcagctcgtcgaccaggagcgccatccgccgcgcctcggactcgatgcgggccagcgcgtattcggtggtgggcggcagcgtcgagctgtcctgacgggtcagttcggcgtagccctgaatggcggccagcggtgtccggagctcatggctggcgtcggtgatgaattggcgcatccgcagatcggagtcgacccgatgcgccagggcgctatccacgttgtccagcaaccgattcagcgcatgcccgacgatcccgacctcgttttgcgggtcggtgtcttgcggttgcacccggaccgtgatccggtggtcgtcgtcggtgagcggcatggcggcgacgtgggcggcgatcgccgccagccggcgcagcgggcgcagcgtgtagccgaccacccacaccgtcagcccggcggtgagcagcagcgccgatgcggtcagcgccacggtggtgagctgtttgcgcgcgatgatccggtcggccaggttgtgtgacaccccgaccaccagcacgtccgagccgttcacggtgctgttgacccggtacggccccagcctgcccaggatttcggtgcgcggcgggctgtccttccacgactgggcggcgaggtcgcggacgacgtcggggggcgcgggccggggttcgtcctcggagaagaccgccgagccgatcacggcgccgttgcgcagcaccgcgatcagattccccggcgtctggccggtgaattccaggatggcctgttggatcggcggggtgcccggatgtggcgaaacatgttcgccgttgcggtatttggtgtactggtggctgaacgcgtccaacgattcggcgacgtcggcgtcgctcatggcgttgacgtagccgcgcaggctcaacaccgagacgaagccgaccgtcaccagcaccacgctgaccaccgccagcacgccgaacagcagttggcggcgcagcgaggagggaaaccaccggggaaatcccccggatgcggtgtcgcggtctcgggtcattccgccggccgcagcatgtatccgacaccgcggacggtgtggatcatcggctcgcggccggagtcgatcttcttcctcaggtacgagatgtacaggtccacgatgctggtgcgcccggcgaagtcgtagttccacacccggtccaggatctcggtgcggctgagcgcgcggcgggggttgcgcatcaaaaagcgcagcagctcgaactcggtggacgacaacgacaccggtgtgtcgccgcgggtgacctcgcggctggcggtgtccaccaccaggtcgccgaccttgagggtttcggcggtcggggcgggctgctggctggcgcggcgcaacagcccgcgcagccgggcgaccagctcctcgaggctgaacggtttggtcatgtagtcgtcggcgcccgcggtgaggccggtcacccggtccatcaccgagtcgcgcgcggtgaggaaaagcgttggcgtgtaagcgtcggactggcgcacccgctccaggatccgcaggccgtccacgtcgggcagcatgatgtcgagcaccagcacgtcgggggccgcccggtcgaacttggccatggcctcgcgtccgttgtgggcgatgtcgaccacccagccctcgtagtgcagcgccatcttcaccaggttggtcagcgccggctcgtcgtcgaccagcaaaaccctgatcggtgacccgtcggcgcggtagatcctgggcaactgccccaggatggcctggcgtggccgctgcgcggctgattgtcccgacattacggtcatgctcctacattctggcgacgcacacataggactgtcaccgagttcatagagttctcaaatgtgggagccggggtgtcgcggccggcgcggctatttccgcgcggcggcgaccggatctaaaagccttgccgcacaggcgtattagtgtgctctaccgacgaaaaacggggccgcgcaccaggcgcggccccgtttgtttcgagacggttgtcaggcccagctggacccgacggcgctgtcggtgctggccatgttgctgcccgcggtctggaccttctggccgtgggcgttggcctgctcgtagatcacctggaagttgcgacccaactgggtgatgaactcctggcaggccaccgaaccggcaccgccccagaagtcaccggcagccagcacatcacgaatgatggcctggtgctcggcctccagggacgcggcctgggcgcggatgagcgcgccgtgggcgtcgacatcgccgaactggtagttgatgctcatagcgattgctccttaaaagtgttggacggcagcagttctgggctagctgctgaggatctgctgcgaagcctgctcttgctgctcgtagttgttggcgtcgcggatcagcccgtcacgcaccccgtgcagcatgttgacgatgttgcggaaggcctggttgacctgacccatcgtgtcgtacgaggtcgcctgggcctgaccactccagcccgcaccggcgatgttcatcgacgacgcccacatcttgcgggcctcgtcctccacggtctgggcgtgcacctcgaagcggcccgccatcgcccgcatttcgtgcgggtcagtcataaaacgtgttgccatctcggctgtctcctatcttgaagcttcagttcgccgaagtcttaacagttgtaattgatgcggtggtggccgcgttggaaatacattacggcctgccggttaattgctcgcctcaaacgggtgacatctacccccttattcgccttatccgcggtctcatcgttagacgacgacctgtttgggcatgacgatcggcttgaagccgtaccggggtccgctgccgtaggcgccggcgcccttggccgcggccgccgcccccggcatgccgggcatcgcggtgaccggctcggcctcggaggcgacggtccagcccgagccctccagcggggcggccgacgaggccagcgatgtggccggcgcggccgccgaccagctggcgggcaccgacagcccgcccaccgcggacgcctcgcccaccgccgccgacgcaccggcgcccgtcaccgagcccaccatcatgcccggcgtgatggccgcgcccgccgccggcgcaaccgagtcggtgagcgagaacgggatcgccggcacggtccccagggtcttgcccagcgacaccgcgttcgggatggtggcacagacccaccaggctgcggtgttgatcgcgccgttggtcgcgttgaggaacgacggggtgcccagcagatcgtcgatggactgcagcagcccgtcggtggggggcgacgtgatcagcgacgagaggtccagacccgccgtctgcgccgtgctgttcgtcgcgtcgaaggcgacggcgccgttgtcaacggccgcggccgctccggggttggtggtcgaggtcagcggcgtcaccggctgcagcactccggcggccgccgaggccgcctggtaggtggccatcatggtggcgtcctgcacccacatctcggcgtactgcgcttcggtcgccgcgatggccgccgagttgacacccaggaagttggtcgccaccagcgttgccagcaacgaccggttggcggcgatcaccggcggcggcaccgtcgcggcgaacgccgcttcgtaggcggccgccgacgcggtggcctgcgcgctggcctgctcgagcgcggccgccgtggtggtcaggtaggacacgatgggctgcgccgcggccgccgccgcggccgacccgccgcccgtccactgttcggtggtcagcagcgagatgatcgactcccattggctggcggtgctgctcacttcggcggacaggttggcgtacgccgtcgccgccgccatcagcgggcccgagcccgcgccggcgtacatgagcgccgaggtgatttccggtggaaccgccgcaaagtcaagaaccattttgtgtatcccgctcctcgaatcggttgaaaactgttgcctgggttgcctagaccgtcgccggcttgggcatgacgatcggtttgacgccgtagcgtggcgccccgaaaccggcgctgttgcgcgccatggtccccaccccgggcatgcccggcaccaccgtgccgacgccggcctgcggagcggcggcggtccagcccaccgtttgcagcggcgcgctgctggaaccgaccaccggggtggcgccggcccaactcggcggcacggacagtttgctgacggtggtcgcctggcccatcgcggcggccggcatcgcacccatgcccgccacgccaccgacaccggccccgcccacgccggttccaccggtgcggtcgaggtggccaggtcggcgccggcggcggcgtcggcgccggaggtgtccagcagcccgccgccggccaggccgagcaggttcgaggtggccgacgcccagttgccgataccgatgttgccgatgttggcgccgttgctcgagaggccgaacatgccgcccagaccgccgctggactggccgttgaagcccagcagccacgccaagatgtcgatcgggttggagccggtggccgcgctggcggtggggtccgcggcgctcagcgcctgcatcgcggtctggctggcgttgacggcctcggtgtcgccgtagctgttggaactgatgcccagggtctgcgaatactgttccagcagcgtctgcgcctcggacgcgatcgcctggtactgggtgccgtaggccgagaagatggccgcctgctgggccgacaccgggtcggcggcggcgggggcgatggcggtcgtcgccgaggccgcgccggcgttttgcgccgcgagattgctgttgatcccactgagcagcgcctcggcggctaacatctcctcagtcgttgtcgtcagaaatgacatccattgctcctcgtgctcaagctggccgacccccggtgtggatcgacccgtgcgctcgcctcgcggccgctgtgcgtgggcaagacgctatcgatccacgactccacgttcccgatcgaaaggcctgagatgacagccgtttacggcttcttaacgacgagggcggcagttttaacacggtcctgtcggacgacatccgcctgtcatctggagtaaacgctcgccggaagtaatcgcgcgcggcgcgcggatcctaatacacgctcagcggaaccgcatgttgtacgtctggcaaattgctgacccgacgcggtgcggtgaaaccagccgccacgcgctagattcgccgccgggcccccatagcccaattggcagaggcagcggacttaaaatccgcccagtgtcggttcgagtccgactgggggcaccgaaactcccggccggacgcgccgggtccgtgaccgtccggggcgccgcgccgcccggtggcgaaatgagcgcctaaccgcttggcgcagaggcgaattcgaagtatccgcccgggcggacaatgacgagcgggctcgcagccgtccggccgagtaagttggtcgcgagcggtgcgcgaccgagcaccacgaaggagccagcgcgacggtgtccgaggatgcacgggccgacggtgtctcgcgccaatacgatcgttggcaatacccgccgccggtcaccgatctcgacgcgtggacgacaaaccactgggactggttcgacccgttctgggcgcatcggctgctgtggcccgaccgcgagtaccgacccgacctcgacatcctcatcgcggggtgtggcaccttccaggcggccgtctacgcctacaccaatagggccgccaaagtggttgccatcgacgtcagccggacggcgctggaccatcagcaattcctgaaggacaagcaccggctgcacaacctggagctgcatcggctcgcgatcgaagaggtcgccgcgctggaccgcgacttcgatctcatcgtctccaccggcgtgctgcatcatctggcggatccgctgaccgggctgacagcgctcggtcgatgcctgcggcccgacggggcgctcggcgtcatgctctacgccagctacggccggatcggcgtcgagatgctggcatcggtgtttcgcgacctcggactctcccaggacgaggcctcggtggaactggtcaaagaggcggtggcggcgctcccggcagaccaccccgtgcacacctatctgaagggggcccgcgacctgtcgaccgatggcgggctggtcgacaccttcctgcacgcccggcaacgcagctacaccgtcgagcaatgcctggagctggtcgccgcggccgggctggcgttccagggctggcttcgcaattcgccgtactacccgcacgacgctctcttcgggagcgccgcaacccaattccagtcggccctgaaccggttgcccgacaccacgttgtggtcggtgatggagcgcctgcaaccggccaacgccacccacttcttcctcgcctgccggccggagcgcccacgggagcgttacaggatcgatttctcgtcgccgacgtatctcggctacgtccccgtgctgcggacggcatgcctgctgtccggtgaccagatccacctgcccggcgccaaactgacgctgaccccggcccagctgccctttgtccaacaggtcgacggccggcgcagcatcgccgagatcatcgacggggtggcgggcgccggccgggatgaccgggcgcgggagttcggtcgtcgactgttcgagtcgttgtggcgcctggacttcctggcgatggggctggccccgggccggtagtggaccaagagtttgggccagccgccggcggcggcgccgacggccactcatacactgacccagcatgggcatgctgttcggcctcgcgccgtggattgtgtattgggtgttggtcggtaacgttccgttcgtggcggccgtgctggtcgcgctggcgctcgccgcggtcagcttgggcctgggcggggtgctgcgcaggcgctggcagctcttcgacttcgcttctgtggcagtgcttttggttctcgccgtgctggccttcacgctcagcgagtcgtttctgcagcggtggatcctgccgttgagcaacgccgggatcttcctggcggcgctggcggggatgctgatcgggaagcccttcgtggccgagttcgccgccgccgaacaggctcccgacgtcgccaagaccgagttgttcggccggatcgtgaaaatcctcggctggatctgggtggcgacgttcgccgggatgacggtgtcgtcggcgatcccgtcggtgctgcagggatccgccggggcggcgcccgcctacatgctggacaccaagaccccgctgtcgttcctgtgctactggatcattccgtttgcgctgctgggcctggcggcggtggtctcgcggctgctgcccgaccggatgctgatcggcatcgacgacctggagcgggaaacctcgttcgtcgcctacgacgaggccaccatcgacgagctctacttcctggcccaggaacacgccaatcgcgaggtcggccccggcaaggaggcctacgccgtcaaggtcggcggcatgggaactccgttgaccggggacgaatctcgaaagtcgtggccgtccacctacaaggtgcgcgacaaacggcgctgagggctacgttgtggtgatggacgcgcccagccccgacgccatccgcgccgagacgatcaccatcacaggccgcggcggcgacgagatcgaggcctaccggccggaggccacggcgatcacgagagcgatcgcccacgcgccggccggactggccgccaaggaccagtagggccgacgatgcccgccgaaccggactacccgcagatggcggccgcgcggggccggatcgaaccggcgccgcggcgggtccgcggttatctgggcgatgtgctggtcttcgacaccaccgccgcccgctacgtgtgggaggtcccctactacccgcagtactacattccactggccgacgtgcgcaccgagttgctgcgcgacgaaaaccacgctcagcgagtgcaattcggtccgtcgcggctgtactccgtggtggccggcggccgcacctgtgagtcggcggcccgggtgttcgacgccgacggcgacggcccgctggccggtaccgtgcggttcgaatgggatccgttgcgctggttcgaagaagacgaaccgatctacggccatccacgcaatccgtacgcgcgggtggacgcgctgcgctcacaccgacacgtgcatgtcgaacgtgaaggaatcacgttggcggacaccagctctcccgtcctgctgttcgaaacaggtttgcccaccaggtattacatcgatcctaccgacgtcgacttcgcgcatctggagcccagcgccacccagacgctgtgcccgtacaagggaacgacgtcgggctactggtcggtgcgggtcggcgacgtcgtgcacgaagacctggcctggacctaccactacccgctgcccgcggtcgcccagatcgccgggctgatcgccttctacaacgaaaaactcgacatcgtcgtcgacgggaccccgctgcctcggccgcacacccaattcagctgagccggccccgatgtgatattcgcctctcttgccgccgatgctgagattcctcagcaaagcagcccgtgaacatgcgagggcgtggttagcggcgcggatgaaatcccccgcatgcgcgtttgcgacggtttcgctgcgggtaagcgactgcgatacagcgtgattggaagtctgagcagaacctgagtgcaccgagtgacgtagctaacgtcgagcattttcgagctgcagtgaggcgaattttggccagtagactaccgaaaaccagtctcgtcagtgcctttcggtgctgaaagccggtgaatccgggggccaattcgccgcgaccgtatcggcggctacgccacctggccacccgggccgacaaacacagcaaaggcggtaccagcgtgagtgatgcaaacgggcctacggcccgattcgggatcgacaacaccgcggtggtcaaagtccctgttcaccacggcccgatcagcgacatcgacgtcagccccgacgggcgccggctgctggtgaccaactacggccgcgacaccgtgtcggtgatcgacacccacacctgccgcgtcgcgagcaccatcgccggtctgagcgaaccgttcgcggtggccatgagcgccgccgacccgaactacgcctatgtcagcaccgccaccgccgcctacgacgcgatcgaagtcatcgacgtcgtcaccaactggcgcatcgccacgcatcggctggcgcacagcctgagcgatctggcggtcagcccggacgggcggtacctctacgccagccgcaacgccgtgcgcggcgccgatgtggcggtgctcgacaccaccacgggcgagctcgaggtgatcgagctggccgccgcggccgggacgaccaccgcctgcgtgcgcgtcagcgccgacggtcgccggctcttcatcggcgtcaacgggcccaacggcggcggcctggccatcatcgaaacccgcacccgcaccgacggccgccgggtcggcggtcgctcccgcctcgtcggcaccgtcgagctcgggctgcccgtccgcgatgtggcgctcggcaacgacggcaacacggcgtatgtggccagctgtggcccggtggtgggctcggtgctcgacgtcgtcgacacccgggccgccaccatcgtcagcacgcacaagatcaacgagatcaccgggccgctgacccggatgacgctgagccgcgacggcgagcgcgcctacctgatcagcgacgaccgcgtcacggtgctgggcacccgcacccaggacgtcctcggtgaggtcagggtgaccaagcacccgtcggccctggtggaaagccccgacggccactacctgtacgtcgccgaccactccggggtgctcagcgtggcccggctctcctcggggaccgcaccggccgcgccgtgcagcggcgccgacgaggacgacgacgcgaccaccggttggctgcccgagctggcgccgtgggagccggtgctggcctagctgcacacaccgcccgagccggccgccaaagtcgggcccgccgaacgggatcggggccgtgcggcccgctcggggtctgccacaatcgccggatccgggcttagggtgggaaagcggccggcggcgcggcgccgtcggccccagatgcggaggcggtgcgcagtggacggcacgatgcaggactttccgttgacgatcaccgcgatcatgcgtcacggctgcggcgtgcacggggcgcgcaccgtgaccaccgcgaccggagacggttaccggcgcaccagctaccgcgaactgggcgaccaggccgcccagctggcgaacgcgttgcgcgggctcggggtgaccggggaccagcgggtggccaccttcatgtggaacaacgccgagcatctcgccgcctacctcgccgtgccctcgatgggcgcggtgctgcacaccctgaacatccggctgttccccgagcagatcgcctacgtcgccaacgaggccgaggaccaggtggtgctggtcgacgcgtcgctggtcaaactgctcgcgccggtgctgcccggcctgcacacggtgcacacggtgatcgtggtcggcgacggcgacaccgagccgctgcggacatccggcaagacggtgctgcgctacgccgacgtcatcggcgccgagccggccgaattcgactggccgcgcatcgacgagaactccgcggccgccatgtgctacaccagcggcaccaccgggaacccgaaaggcgttgtgtacagccatcgttcgagtttcctgcacaccatggccgcgtgcaccgccaacggcatcgggatcggggccagcgacagcctgctgccgatcgtgccgatgtttcacgccaacgcctggggcctgccctacgcggcgctgatggccggcgcggacctggtgctgcccgattgccacctcgacccccgctcgctggtgcggatggtcgaagacctgcggcccaccgtgaccggtgcggtgccgaccatctggaacgcggtgctgcaccacctggaagacgagcccgaccacgacatgtcgtcgctgcggctggtggtctgcggcggctcggccgtaccggtgtcgctgatgcgcaccttcgaggagaaacacggcgtgcagatccggcaactgtggggcatgaccgagacgtcgccgctggccaccatggcctggccgccgccgggaacgccggaggaccagcactgggcgtaccggggcacacagggccaaccggtctgcggggtccagatgcgcatcgtcgacgacgacggccgcgtcctgcccaacgacggcaccgcggtgggggaggtggaggtgcgcggcccgtggatcgccggctcctactacctgggacgcgacgactcgaagttcgactccggctggctgcgcaccggcgacgtgggccgcatcgacgagcggggcttcgtcacgctgaccgaccgggccaaggacgtcatcaaatccggtggcgaatggatctcctcggtggaactggaaaactgcctgatcggccaccccgacgtggtcgaggccgcggtggtgggagtgcccgacgagcggtgggaggaacgcccgctggccgtggtggtggtcaaggacggcgcctcggtcgacgccgaccagctgcgaaagttcctggccgacaaggttgtccgctggtcgctgccggagcggtggacgttcgtcgacgagataccgcgcaccagcgtcggcaagtacgacaagaaggccgtccgctcccgctacgccgacggcggctaccgggtgatcgaagcgcgcgactgaaaggcttggcacagtggcagattcactcgtcgtcgcccaatccgtcgtcgcccccgttgccgcgtcggacgcgttcggccgcacgctgccgatgccgttgccgacgctgttcaaccggtggtacggccccttcccgccgatcagggaggtgcgcggacagaccggggactgggacgcggcgggccggcagcgcatcgtgcacctggccggcggtgccagcatgcgcgaggaactgaccagcgtcgacccgccgcggtcgttcggctaccggctcagcggcatcaccggcccgatggcgctgctggtgaatcatgtgctcggcgaatgggttttcaccccggcggccggcggaaccgagatcacctggcgctgggacattcatcccaggtcgccgctgaccgcctgggcgcttccactgctgggcaggatgtggaagggctacgcgcgacgcgcgctggacaacctggtggccttgctcacccgctgagtcccgccggccgttacggtaagagcccatgtgtcgactcttcggcctgcacgccgggacacgcgcgtgcaccgcgaccttctggctgctcgacgcgccggacagcctggccgaacagagccggagaaaccccgacggcaccggcctgggggtgttcgacgagcacgcccgcccgcagctgcgcaaggagccgatagccgcctggcgggacgccgcgttcgcgcgcgaagcgcatcagctgaccggcaccaccgtcatcgcccacgtccgctacgcgaccaccgggtcgctcgacgtccgcaacacccacccgtttctgcaggacggccggatcttcgcgcacaacggggtgctggaggggctcgacgtaatcgacgcgcggctgcgtgaggtcggcgtcgacgggttggtgttgggcgacaccgactccgagcgggtgttcgcgttgatcaccgccgcgatccgggcccgcgacggcgatatcaccgcgggcctggtcgacgccgtccgatggctggccgagcaggtcccgatctatgcggtcaacctgctgctgagcaccgccaccgagatgtgggcgctgcgctacccgcacacccatcagctctacgtgttggatcgctccgccgacgcggcccggcaacccgaattcgacttgcacaccatacgaattcacgcgcgttcccagcagctgtgcacccggccgtcggtggtgttcgccaccgaacgcatggacgccgacccgcgttggcggctgctcgagccgggggagctggcccacgtcgacgccgggctgcgagtcagccgccgcctggtgctgcccgacccgccccggcggctgctgcgccgcgacgagctgagcaccccggtgcgggactcccagcacgcactgcccgacacccggcggaccggctgaggccgtttggcagagtggttcgacgtgacaaccaaacgcgccctggtgctcgccggcggcgggatcgccggaatcgcctgggagacaggtgttctgcggggcattgcggacgagtcgccggcggtggcgcggctgctgaccgaatccgacgtgctggtcggcacgtcggcgggttcagcggtcgccgcccagctgtgcagcggccacaccctcgacgcgctgttcgatcggcaggtcgccgcctcctcgcccgaaatcgattccggggtcgacgtcgaggccatcaccgagctgttcctgaccgccctggccgaaccgtacgacgactcggaggacaagacccgccaacaattgcggcgcatcggggcggtggcgctggccaccgacaccgtgccggccccggtgcgccggcgggtgatcgcggcgcggttgccgtcgcaccggtggccgcgacgggcgttgcggctcaccgcaatcgacgtcgacagcggcgagctgaccgtgttcgacccggcgtcgggcgtcgacctcgtcgacgcggtggcggccagttgcgcggtgcccggggcgtggcctccggtggccatcggcggccgccgctatatggacggcggggtggccagctcggtgaatttgggggtggccgccgactgcgacgtcgcggtggtgctggtgccctcgggcgtcgacgcgccgtcgccgttcggcgccggcccggccgcggagatcgcggcgttccccggccgggggttggccgtcttcgccgacgaccgctcgctggcggcgttcgggcccaacccgttggaccccggctgccgggtgccctcggcgcgggccggccgcgaacagggccgccgcgaagccgcggccgtcgccggattcctgggtgtgtgacgaatcccgttgccgggcaatcggttcagcgctcgaccgcggggctgtcgtcgtcgccgtcctcgaggtcgtcgagggcttggtcggccaacgcccgccccgcgtcgatcacctccaccgcccggtggaattccaggccccggcagatcgagcggggcacctcgatgagcaggtcgggtgggtagacggccagcgtgtgccgcgccagcgccgcctgggcgatgtcgatggtgcggttcatcacctcgaagctgcccagtttgggcacatccgttgccgcgccgggcaattcgacggcctcgtcgtcgtcatcggcgagcaccggctggtcgggttcctccggattgtccggccaggcgtcggcgtcgccgctcggcccgcccagccggctcagcaccgcccgcgcggtgcgccgatcgagcagcgagcgggcggcggccgtgtcgaacagcgccgaggtgctgcgcatcatgcgggtcaaccactcggcggtggcggccggttcggcctcgcgacgggtgatcgcctcgctgccggacaggttcaccgcgatggtcagatcggcgttgacggccgagagcggggccatcggcagcgggtcgaggatgccgccgtcggccagcagccggccgtcgagggtgtgcggggcgatcacccccgggatcgcgatggacgcgcggatcgcctcgtccagcggcccgcgctgaaaccacaccgacttgccggccagcaggtcggtggccaccgcggtgtaggggatgcgcaggtcctcgatggccaccggccccaggatgtcgcgcaccgcgtccaggatcttgcccgcccgcatcaccccggccgcgctgatggacgggtccagcagccgcaggatggtgcgctgggtcagcgacttggcccactcggcgaactcgtcgagccgtccggccgcttgcaggccgccgaccagcgcgcccatcgacgagccggcgacgccgacgatgtcgtagccgcgggcttgcagcgcctcgatcaccccgatgtgggcgtagccgcgggcgccaccgctgccgagcgcgagtgccacccgagtcggtgctgatcgacgttcctcaggcacccctccattttgcgcggccgccggccggcaggggtgcgcggcggccggctagtgggcgctcgcggcggtcggcgggcgcggcccgggcagttttttcaaccgtgatcgcaattgtctttgtccaaccggggtgccgtcacccgcattcgtcgttcgcggccgcccgggcggcgacgatcacggccgcctgccgggccggcgtcaacgccgaccacggcgtgttccagctgcccgcggtgcccgacggcgacgcctgcaccatcgccaggtacggctcgaacagcgacgcacccgtcttgggctgggcgtccatccactccttggcggcgtgacaggcctggtagtactcctcttcggtggagtccgccgggatgtcgacccgggtcgtcacgccgcccggggacagcccgacggcgcccggcggcgccgcggcggggccggcggggatgcccgtttgccgcgccggtgcgggcgtcggcgcgccgcgcggggcgccgtgcgagcacccgggggccgccgccacaacccccagcacgatgcccaccagaacgaccgcgccccgtcgccgggaccgatcaccgcgccagcgcacggtcccaatctatgcaacactggctgccgtgatggagcgcttcggattttgcgagtgttgtcggccgtaacacgccgccgcccgatccgttttcgcttcctggagttctttcctcatgcctgtgcccgccgccaccctggctgccctgcgcccgcctttcccgtcgtcgccgtcgccgggtccgacccggttgcgggtgcccgacctgctctatgccaccgatcaggccgccgacgacgtgctcagcgggcgctgcgaccacctgctgcccccgggcggcatcccggcgtcgcggcgctggttcacccgcatccacggcgacgaggagctcgacgtctggctgatcagctgggtgcccggccacccgaccgaactgcacgaccacggcgggtcgctgggcgcgttgaccgtcgtctccggatcactcaacgaataccgttgggacggtagggctttgcgacgccgccggctcgacgccggcgatcaggccggcttcccgctgggctgggtgcacgacgtggtgtgggcgccccggccggtcagcgggccggtcagccgtcgggccgtcgccgccgcccaggcggcgccgacgctgagcgtgcacgcctactcgccgccgctgaccgcgatgtcctactacgacatcactgagcgcaagacgctgcgtcggcaacgcaccgaactgaccgaccagccggaaggatcgtgatgagccgcatcgacgtcgtgttgaggtccgcccggcgccggttccgccggctgcccgccgtcgaagtgcccgacgcggtgcgccgcggcgcggtgctggtcgacatccggccgcaggcccagcgggtccgcgagggcgaggtgcccggcgcgttggtgatcgagcgcaacgtgctggaatggcgctgcgacccgaccagcgaggcccggctgcccgaggccgtcggcgacgacgtcgaatgggtgatcatctgttcggagggctacacgtccagcctggccgcggccgcgctgctggacatcggcctgcaccgcgccaccgacgtgatcggcggctaccacgcgctggccggggccggggtgctgagccggctggccggcggtccggtcggcgccccgctggccaacaccggcgccggcgagcgccgctggatctagccgttggcgtgcagcagcggccgcagccggtccgtcttgtcgggtgtccaccccggcggtgacagcaccgatgcccaggcgtcggcgacgtcggcgacgtagtggtggccgtgcccgtcgggcacgttctgggcgaccgccatgtccgccgagacctgcaggaacgtcaccaccgggatccaggtggtctccggcagcacgtcgtagccgcggcgctccttgagccagtccggccgggcgaacaacaggtcggtggtccaccacgcgatcggatccgaggcgtgctgcaggtagaccacccgcgggtgatcccacggatccttgggccgcgccaggttcgccgcgcgcgccacgaagcggacattgcggccgtcgttgtagatcggcaaccactccggtgacccggcgtcgcgcgtcgacgtcagatcggtccagatggtgttgttgaacgtcgggccgctgaacagggcgccgtcggtgcgggccagcacgttgttcaggctcatgaacggcgcctcgccgccgaacgagcccaggctctcgccgaacaccaccagcttggggcgctgagcctcgggcagctggcggaccagccggtcgaccgcctcgaacagcgcctgaccggcgtgccgggcgttctccttgtccaccaggaacgacagccagctgggcaggaacgaatactgcatgctgacgatcgcggtgttgccgttgtacatgtactccagcgcggtggcctcggcctcgttgatccagccggtgccggtggtggtggccaccgcgacgacggcgcgccgcagcccgccggtgcgctgcaactcccgggtggccagctcggcggtggcggtgatgccgtcggcggagttcagccccgcgtaggcgcggatcggctcggtggccggggcgccgttgaacgcggtcagctgttccacccgcggcccgccttcgatgaagacgcggccctggtggcccagcgactcccaggacaccagcgactccgggccgccggagcgcagcggggttttcggcggcgcggtgtccgggctcatctcgttgttggccgaggcgaaggtgttgttcatggtgcgcatggcgaacttcagcaccacaccgttgagcagggtgatggtgagcaccaccagcagggccaccacgatggtcgccgacagccgaaacggcgcgatccggtcgagccggccgaccaggaagctgaccagccagcgggtgaattggccgatctcgacgcaggtgaacagcaccaccagggaaagcacccccgccaccgggtagtcgtaccacttcaggtgcgccacacccatcaggtcgcgcaccttgtcctgccacacgtggaaccagatcgccatcaacaccatgccgaccgcgccgaccgggatcaggatcttccaggcccagcgcggcggcgggggactggacggtttggcccacaggtaccggtagagccagacggcgaagacgcccagcccgtagccgatggcgccggagatgccgctgaccaatccctggaatatcgccccgcgcggcagcagcgacggggtcagcgagaaccagatgaacaccagcccgaccgtcgtgccggtgaacgtgtaatgccgtacccaccaaggcttttcgggctgctgtgtgccgggtgcgggcgctttgggtgcggggtgctccgcgacggcggtctgcgcgccggttcgggttccgtccggcgccgtttgctgctgcgccggctcgtcgccggtgtcggtgtcggtcgcggaacccggttcgctcatcgaggcgtcctagcggtgggtgaagttcggcgcgcgcttctcgacgaaggccgccatcccctcggtctggtcggcggtggcgaaagtcgaatggaacaaccggcgttcgtagaggagtccctcggccagggtggtttcgaaagcgcggttgacggcctccttggccatccgggctgccgaccgggacatctgcgaaatcgtggtggcgaccttcttggcctcggtcagcaggtcgtcggcgggcaccacgcgcgaaaccaggccgctgcgttcggcttccgcggcgtcgatggtgcggccggtcaggatcaggtccatcgccttggccttgccgatggcgcgggtcagccgctgcgatccgcccatgccgggcagcaccccgagtttgatctcgggctggccgaatttcgccgtgtcggcggcgatcagcacgtcgcacatcatggccagctcgcagccgccgccgagggcgtgcccggccaccgcggcgatcgtcggggtgcgcaccgcggcgagcttgccccagggggcgaagaagtcggcgccgtaggcgtcggcgaaggtcagctcggccatctccttgatgtccgcgcccgcggcgaacgccttggccgatccggtgatgatgatcgcgccgatgccggggtcggcgtcgaaatccgttgccgcggcggtgacctcgttcatcacctgggtgttgagcgcgttgagcgccttgggccggttcagggtgatgatgccgacgcgctcctcgcgctcgacgaggatggtttcgaaggtgcggtcggtgctgtctgtcatccaaatcgcctttctagaaactcaagtcgtcgtccaccggggcgaaatacgcctcgacgtcggccgcggtgacgtcggccagccgggcgggcgaccactgcggattgcggtccttgtcgatcagctgcgcccggatgccctccaccagatcgtgtgagcgcagcgacgccgacgacacccgatagtcctgcaccagaacgtctttcagtgtcggtaggtcggccgctcggcgcaccgccgccagggtcaccgacagcgcgatcggtgagcgggtggcgatcaggtccgcggcgtcgtgcgccgggctcgcgccatgcgcgcgcagcgcggcgacgatgtcctcgacggtctgccccgcatagcactcgtcgatccaatcacgttgggccgcaagctcaccgggtggcggctcgacggcgtatttggccagcgcgctctcgacgccgtcggcgaccaccgcgcggcggaacgcctcgacgtcggcgtgcggcacgtagtggtcggcgaatcccatggcgatggcgtcggcgccggagaacggcgccccggtcagcgcggcgtgcaggccgagcccgccgggcgcgcgggacagcaggtaaacgccgccgacgtcggggatgaacccgatgccgacctcgggcatggcgaccttggaggtgtcggtgaccacccgggtgttggcgtgcgcgctgacgccgacgccgccgcccatcacgatgccgtccatcaccgcgacgtagggcttggcgaactccgagatctgggcgttgagctgatattcgtcgcgccagaagcgtcgcgcctcgacgccgtccttgcgggcgctgtgatagatggacaccacgtcgccgccggcgcacagcccgcgctccccggcgccggacagcagcaccgcgcgcaccttgtcgtcgcgcgcccagtcggtgaggacagcgctcagcgcgtcgatcatcggctgattcagcgagttgatcgccttggggcggttgagcgtgatcaggccgacgtttccgtcgacttcggtgagaacctcgtcggatccgtcggtcacgccttcgcctcccatcgccggttcagcctcgaggaagaaatctagatcgtcacgaccggcgcggtatccgcgggtaagggttatctttaacgcgacgacaacggtgcaggctctccaactcgagaaacgcccaggtccgctgggaaccggggggagccgctgatcgttgagatggtgttcgcacagctcgatgccaatcagagaggatccgacggtgcgggagacaagcaatccggtatttcgttcgctgcctaagcagagcggcggatacgcgcaattcggcactggcgcggcccccatgcagggctatcaagccgacccctacgcggctccctatgcgactccgtaccaggagaccagggcgtcgcggccgctgaccatcgacgacgtcgtcaccaagaccggcatcacgctggccgtgctggcggcatccgcggtcgtctcctacttcctggtgctgtcgaatgtggccctggcgatgccgctgaccctggtcggcgcgctgggcggtctgggcctggtgctggtcgcgacgttcgggcgcaagcaggacagcccggcgatcgtgctcagctacgcggttctcgagggcctgttcctcggcgccctttccttcgtgttcgccaacttctcggtctccagcgccaatgcgggcgtgctgatcggtgaggccgtcatgggcaccttcggggtgttcttcgggatgttggtggtctacaagaccggcgccattcgggtcacccccaagttcacccggatggtggtcgccgcgttgttcggcgtgctggcgctgatgctgggcaacttcgtgctggccatgttcggtgtcggcggcggcgccggcctgggcctgcgcagcggcggcccactggcgatcatcttctcgctggtctgcatcggcatcgcggcgttcagcttcctgatcgacttcgacgccgccgaccagatggtgcgcgccggtgcgccggagaaggcggcgtgggggatcgcgctcggcctgaccgtgacgctggtctggctgtacatcgagatcctgcgcctgctcagttatctacagaacgactagctctctcggcatccgagaaaaccggcgcgcccgttggcgcgccggttttttcatgcggcgcgcgtcgagtgtgtggtggtggcgttcggtgttgcaccgcggcgcgtgtcgtcggcgtgtcgtctaccaggattcacactcgacgacgccgggaacgacggacgcccggagacaccgcgacgcctcagctgaggcgctcgatcaccatcgccatgccctggccgccgccgacgcacatggtctccaggccgaacgtcttgtcgtgggtctgcaggttgttgagcagcgtggtggtgatccgggcgccggtcatgccgaacggatgacccagcgcgatcgcgccgccggacacgttcagcttgtcctcgtcgatgcccagctcgcgggccgagcccagcacctggaccgcgaacgcctcgttgatctcgaacaggtcgatgtcgctgaccgacattttggcgcgggccagcgccttcttggtggcctcgatcgggcccaggcccatgatctccggcgacaggccgctgaccccggtggacacgatgcgcgccagcggcgtcaggccgagctcttggccttggtgtcgctggtgatcaccacagccgcggcgccgtcgttcagcgggcaggcgttgcccgcggtcaccgtgccgttgggccggaacaccggcttgagctcgcggatcttctcgtacgtggtgccggggcgtgggccgtcgtcggtgctgaccgtggtgccgtccggcagcgtgaccggggtgatctcccgctcgaagaacccgcttttgatcgcttcctcggcgcggttctggctgcgcaccccccagtggtcctggtcctcgcggctgatgccggtcagcagggcgacgttctcggcggtctgccccatcgcgatgtagatgtcgggcagcttgccgtcggcgcgcgggtcgtgccactcctcggcgccctcggccgcggcggccgaccgctcctgcgcctcgctgaacagcgggttcttggtgtccggccacgagtcggcgctgcccttggggaaccgggacaccgtctccacccccgcggagatgaacgcgtcgccctcgccggccttgatcgcgtggaacgccatccgcgaggtctgcagcgacgaggagcagtaccggttgacggtggtgcccggcaggaagtcgaagcccagctcgacggcgaccacccgggccaggttgaatccggactcaccgccgggctggccgcagcccaggatcaggtcgtcgatctggtgcgggttcaacgccggcaccttgtccagcgcggcgcgcacgatctgcacggccaggtcgtcggggcgcatgctgaccagcgatcccttcatcgcgcggccgatcggcgagcgagcagttgagacgatgacggcttcaggcatggttgttcccttcagatccctgcgggtccctcgaatggggctggctcgcgtcaccaccgggtaggtccaccccgacgggcgagaacaaatctagtcgctgccgacctcggggcacgacgacggggcggcaccgggcgccggacggcgccacagccgcgacatcacgctgctgcgggtgtgccgctgcccgagcaccggctgcgccgagggcaccggctggttcagcggcggacgctccacctgctcgcccagcgcctcgcacagcgcgagcagcagcgcgtcggccgccagcgcgtaggccggggccgaggggtggtagccgtcggcggagaacatcgcctccggggtggcccggaactgcggcgccatcagctgagccagaggcaccggcaccccgccggcggcgcggaccgtcgccgtctgggcgcgggcgagttgcaggcaccgctcgtgcgccaacgatcgcagcggttgcggaatggcgctgatgaaccccagatccgggcaggtgcccacgatcaccaccgcgccgcggttccgcagtttgcgcacgcacaaccccagccgctgcgccgactggctgacaccgttgagcgccgtcacgtcgttggcgccgaccatgatcaccgccacgtccggcggcggaccggccacgaacatcgcatccacttggccgcacacgcctttcgacgtggcgcccacaatggccttggtgctcaaccggattcgcttgccggtctgctcggccaggccccgcgcgatgcgcacccccggcacttcgtcggcgcacatgcagccgtatccggcggcggtggaatcgccgaagatcatcaggtgcaggtcgacggccatgccgcggtgccagcgctgcaccggcccgccgccgcgggtgtacacgccgtcggcgcgcggcgggatgtcccacgacttggggatgacggtgcgcgcgtgggtggcctggccgaccagcagactgcgtgcccccaggtaggcggttcctgtcgaggccagcgcgcccgctgtggccagggcgatcgccgaacgacgtggcacccgaatggtcacggcatcaagtttagaggcgctttggagtttgcggaggcggctgaaaaacgaactgatcacggtgcgaagcaaaactggtatcaaatcagagatttcatacgttgtgctaagcaacggctgtcaagctgagagcgaggggatggctgagcgccttggcacacggctgaaccagacgctcaacagcctcgtcacatgctgtatcgcactacaacggcgtaggaagtgttgagcatgaccgcaccgagcgaggtatcgggaccgcagagtcccgtccgtgtccacgacgtcctcaaggcgcgccgcgcgcgcatccgcaagttcgcgatcagcgacggcgcaccggtcgaggttctcgaatccggacccagcgttgctgcgcgactggccaacctaacctcacggctgaccatccggccgattctggccgtcggcagccacgcccccaacctgccctggccgtggggtctgatcgacctcaccgcccgggtgctgctgccggtgtcggccaccgtgcgcgagacggtggcgctgccgcacgcgtcggcgcagctggtccgcgcgcccggggtgctgcccgccgacggcacccgccgcgtcgtggtctacctgcacggcggggcgtttctgacctgcggggcgaactcgcacggccggctcgtcgaagccctttccaccttcgccgacgcgcccgtgctggtggtgaattaccgtctgctgccgaagaattcggtcggcatggcgctgcaggactgccacgacgcgtaccagtggctgcggctgcgcggctaccagcccgaccagatcgtgctggccggcgactccgcgggcggctacctggcgctgacgctggcgcaacgcctgcagcgcgagggtgaggaacccgccgcgctggtgatgatctcgccgctgctgcagctggccaaggagcccaagcaggcccaccccaacatcgacaccgacgcgatgttcggcgccggcgcgttcgacgccctggccgagctggtggccggcgcggcggcgaagaacatcgtcgacggcaagcccgaggagatctacgagccgctcgagcacatcgagccggggctgccgcgcacgctgactcacgtgtcgggctccgaggtgctgctgcacgacgcccggctggcggcgagccggctggccgcggcgggcgtgccggccgaggtgcgggtgtggccgggacagatccacgacttccagctggccgcgccgatggtgcccgaggccaggcggtcgctgcgccagatcggcgactacatccgcgaggccaccggctgagtccttgtgcgccgcgggaaaccgcctgagacgatgtgacgcatgcggatcgcgcagcacatcagtgacctcatcggcggcacgccgctggtgcggctgaactccgtcgtgcccgacggcgcgggcatcgtggcggccaaggtcgaatacctcaaccccggcggcagctccaaggaccggatcgcggtcaggatgatcgacgccgccgaggccagcggggcgctgaagcccggcggcaccatcgtcgaacccacctcgggcaacaccggcgtggggctggcgctggtggcccagcagcgcggctacaagtgcgtgttcgtctgcccggacaaggtcggcgaggacaagcgcaacgtgttgatggcgtacggcgccgaggtggtggtgtgcccgacggcggtgccgcccgagcatccggacagctactacagcgtctcggaccggctggtcaccgagatcgaaggcgcctggaagcccgaccagtacgccaacccggagggcccggccagccactacgccaccaccggcccggagatctgggccgacaccgacggcaaggtcacccatttcgtcgccggcatcggcaccggcggcaccatcaccggcgcgggccgctacctcaaggaggtgtccggcggccgggtccgcgtcatcggcgccgaccccgagggatcggtgtattccggcggcaccggccggccctatctggtcgagggcgtcggcgaggacttctggccgcaggcctacgaccgcacggtgcccgacgagatcatcgcggtctccgactccgactcgttcaacatgacccggcggctggcccgcgaggaggcgatgctggtcggcgggtcctgcggcatggccgtggtggcggcgctgcgggtggccgagcaggccgggcccgacgcgctggtggtggtgctgctgcccgacggcgggcgcggctacatggcgaagatcttcaacgacgcctggatgtcctcctacgggttcctgcgtacccggctggacgggtcgaccgaccagtcccgcgtcggcgacgtgttgcgccgcaagtccggtgagctgcccgacctggtgcacacccacccgtcggaaaccgtgcgcgacgccatcggcatcctgcgcgagtacggggtgtcccagatgccggtggtcggcgccgagccgccggtgatggccggcgaggtcgccggcagcgtctccgaacgtgagctgctgtcagcggttttcgagggccgggcgaagctggccgacgcggtctcgctgcacatgagcccgccgctgccgatgatcggcgccggcgaatcggtcagcgcggcgggcaaggcgctgcgcgattgggacgccctgatggtggtcgaggagggcaagccggtgggtgtgatcacccgctacgacttgctcggtttcctctccgagggaccccgcggatcgggcgggcggcgctaggtcgcgcgtctcgctcggacgtcgaaccctcgggtactgtttcggcctagttcgactgatgtccagctgacccggagtggaaggttgcccatgaccgatcaaccgccgcccggcggcgcctacccgccacctccctcttcgcccgggtcgcccggcggtcagccgactccgcaccccggtgggcagcagccaccgcctccacccggcgggtcttacccgccgcccccgccgcctggcggatcctatccgccaccgccgccgccgtcggggggatacgcgccgccgcccccgggaccggcgatccgcaccctgccgacgcaggactacacgccgtggctcacccgcgcgctggcgttcgtcatcgacatcctcccgtacgtcgtggtgcacggcatcggcaccgcgatcctggtggccacccagcagaccgcctgcatcaccgacgtcacgcagtacgcggtgaaccagtactgcgccacccagaactcgacgcttggcctggtggcgcagtggttggcgtcgatcgtcgggttgttctacctgatctggaattacggctaccggcagggcaccaccgggtcgagcgtgggcaagtcggtgatgaagttcaaagtggtcagcgaggtcaccggccaacccgtcggcttcgggatgtcggtggtgcgggcgctggcgcacttcgtcgacgcgatcatctgcttcatcggattccttttcccgctatgggattccaagcggcagacgctggcggacaagatcatgacgaccgtgtgcctgccgctcgacggctccgaaagcccgccgagctagggccggccaccgcggccgtcccctaggctgatcgtcgatgagcgacgacggcaacgcacaccccgagttcagcggactggccaccaaggcgattcacgccggctaccggccggacccggcgaccggagcggtcaacacgccgatctacgccagcagcaccttcgcccaggacggggtgggcgcgctgcgcggcgggtacgagtacgcccgcaccggcaacccgacccgggccgcgctggaggccacgctggccgcggtggaggccggcagccacgggcgggccttcgcctccggcatggccgccaccgactgcgcgctgcgggcggtgctgcggcccggcgaccatgtggtgatcccgaatgacgcctacggcggcacctttcggctgatcgacaaggtgttcactcgctggaacgtcgaatacacgccggtgccgttgcatcagctcgacgccgtggccgccgcgatcacgccgcgcacccggctgatctgggtggagaccccgaccaacccgttgctgtcgatcgccgacatcgccgcgctggcccagctgggccaccagcactcggcaaaggtgttggtggacaacacctttgcctcgccggcgctgcagcagccgttgacgctgggcgccgacatcgtgctgcattccaccaccaagtacatcggcgggcactccgacgtggtgggcggtgcgctggtcaccaacgacgccgagctggacgacgcgttcgggttcttgcagaacggggcgggcgcggtgcccggcccgttcgacgcctacctgaccatgcgcgggctgaagaccctggtgctgcggatgcagcggcacaccgaaaacgcctctgccgtagcgcaattcctcgccgggcaccccgcggtgagcgcggtgctctatcccggcctgcccggccatccgggccacgacgtcgccgcccggcagatgtcgggcttcggcggcatggtctcggtgcggatgcgcggcggccggcaggccgcccgaaagctgtgcgccaacacccgggtgttcatcctggccgagtcgctgggcggggtcgagtcgctgatcgagcaccccagcgcgatgacgcacgcgtcgacggcggggtcgcaactggaggtgcccgacgatctggtgcggctgtcggtcggcatcgaggacgtcgacgacctgctggccgacctcgaccgggcgctcagttgatacgccgagcgctcggactcaggagtggtagggctccgcgctgaccagcgtgacctcgacggtgctgccgttgggcacggtgtagctgcgggtctcgcccaccttggcgtcgatcagcgcgccgcccagcggtgaattgggcgagtacacctcgagcttgccgtcgttgacgccctcctggcgggtggcgatgaggaacgtctcggtgtcggacttgtcgccgttgtagtagaccttgaccaccgagccgggcagcgcgacaccggactgcttgggcgcctcgccgaccttggcgttgttgagcagatcctgcagctggcgaatccgggcctcctgttggccctgctcttcgcgcgcggcgtggtagccgccgttctcgcgcaggtcaccctcctcgcggcggtcattgatctccgcggcgatgaccggacgattcgcgatcaactgatcgagctcggccttgagccggtcgtgcgactcctgggtaagccaggtcacggaagtatccgtcatctcgtctgctcctcgtatgttgttccgcgagttcgcgtaagtcctgttaactccgtcgcccagaacgtgcgggtgccttcccgtgtgctgctgccccgttttgctcacggccgctaatgcagcaacacggccccaaccggaaccgtgcattcatccatgttaccaccgtgcaaacagtcgatgactccaaattcgcagttcggcgtcgatccgggccggtcaggacggccgcagatagccgggcacgtcggtgccgcagccgtagacgtcggccaccaccggcggctggaaagacttcaccgtcgtcgtcacctccacggtggccgcgccggacggcaggaccagcagctcgcgccggccggtctcgccgccgtcgtgggagcggacccgcacgatgcagtccaccgggcgggacggatccgatcgcgtcacgctgatcgtgatcgacgcggtctggtcgtcgagcacccggtacccgaccatcgtcgccttgacgtcgctggtgccgaaccggtgatagccgacgacggccaccgccagcccggcagccaccaccagcacgcccagcgcggcgatcacccaccgccgcggaatgcgcgacagcggcgaacggccgtagcgctcgctcgggcgggtttcggtcatggtggttttgcctggtcattgggcgccggcagcggccggcagcgggcacggatgcggaactggaattatagggtcagatcgggcgaccaccggaagtgacaagggagcacgtgagcgaattgcggttgatggcggtgcacgcccatcccgacgacgagtccagcaagggcgcggccaccctggcccgctacgccgacgagggccatcgggtgctggtggtgacgttaaccggcggcgagcgcggcgacatcctcaacccggcgatggacctgcccgaggtgcacggccacatcgccgaaatccggcgcgacgaaatggccaaggccgccgagatactcggcgtcgagcacacctggctggggttcgtcgactccggattgcccaagggcgacccgccgccgccgctgcccgagggatgcttcgcgctggtgccgctggaggaggcgatcgaggcgctggtccgcgtggtccgcgaattccggccgcacgtgatgaccacctacgacgaaaccggcggctacccgcatcccgatcacattcgctgccaccaggtttcggtcggcgcctacgaggcggccggcgactaccggcgcttcccggacgccggcgagccgtggacggtgtccaagctgtactacaaccacggcttcctgcgggcgcggatgcagctgctgcacgacgaagcggtcaaacacggtcacgaaccgccgttcaagaagtggctcgagcattgggatcccgcccacgacccgttcgagtcccgcgtcaccacccgcgtggaatgctcggcctatttcagccagcgcgacgacgcgctgcgggcgcacaccacccagatcgacccggaccacgacttcttcgccgcccccatcgcatggcagcaacggctttggcccactgaggaattcgagttggcccgctcccgggtcccggtccggttgcccgaagacgacctgttcgccggaatcgagcccgacgcgtgaaccacctcctggtgctctccggtgcggtggccgacggcgcaccgcaccacaccggacccgacttcggcaaggccagcccggtcgggctgctgatcgtcgtgctgctgttgatcagcacgctgttcctgctgcggtcgatgaaccggcaactgcgcaaggtgcccgaatcgttcgacccccaacaccccgagccggatcaggccgccgacgagggcaccgacgcggtcgacgcggaggacgcaccggacgccgatcccggcccggaccacgccaacgggtcaccgcgacccccgggatccgacgatgagcccggctgacccgtcggccacgaatacccttgggcgggcgaccagcccgtatctgcgccagcacgccgacaacccggtgcactggcagcagtggaccccgcaggcactggccgacgccgccgcccgcgacgtgccgatcctgctctcggtggggtacgccgcctgccactggtgccacgtcatggcccacgagtcgttcgaagaccccgacgtggccgcggcgatgaactccgggttcgtctgcgtcaaggtcgaccgcgaggaacgccccgacatcgacgcggtgtacatgaacgccaccgtcgccctgaccgggcacggcggttggccgatgacgtgtttcctgacaccggacggccggcccttcttctgcggcacctactatcccaaagacgccttcctgcaactgctttcggctgtctcggccacctggcgggagcgccgcggcgaggtcgaggaggcgtcggaccgcatcgccggcgagctgcgcaagatgacctccgggctgcccgcgggcggtgcggacctcgcgacggcgctgtgcgacgaggccgtcgccgcgatcctcgccgaccgggacacggtgcacggcgggttcggcggcgcccccaaattcccgccgtcggcgctgctggaggcgctgctgcgcagctacgagcgcaccgggtcagcagcggtgctgcaggcggtggcgcacaccggtgcggcgatggcccgcggcgggatctacgaccagctgggcggcggcttcgcccgctacagcgtcgacaacgcttgggtggtaccgcatttcgagaagatgctgtacgacaacgcgctgctgctgcggctctacgcgcattgggcccgccgcacctgcgacccgctggcggcgcgggtcacggccgagaccgcgcggtttctgctcgacgacctcgccgacggcgacatgttcacctcgtcgctggacgccgacgccgatggccgggagggctcgacctatgtgtggacgccggcacagctgacggaggtgctcgggcccgacgacgggcgttgggccgcagcagttttcggggtcaccgagaccggaacgttcgagcacggcagctcggtgctgcggctgcccgcggacccgccggacaccccgcggttcgaccgggtgcgcgcggcgttgctggccgcccggcgcggccgaatccagccaggccgcgacgacaaagtcgtcacgtcctggaacggcttggccatcaccgctttcaccgaggccagcgttgcgctggacgaccccgggctcgccgacgccgcccggcgctgcgcacggtctgtgctcgacctgcacgtcgtcgacggcaggctgcgacgggccagcctgggcggggtggtcggcgacagcgccgccatcctcgaggaccacgcgatgctggccaccggcctgctggcgctgtatcagctgagcgccgaggacagctggctgaccgccgcgaccgacctgctcgacactgccctggcgcatttcgccgatccgcagcggcccggccgctggttcgacaccgccgacgacgccgagcggctgatgctgcggccggccgacccgctggacggggccaccccgtcgggcgcgtcgtcggtcaccgaagccctgctgaccgccgcgcacctggtcggcggcgagcgcgccgagcggtacctgcgcgccgccaccgacgcgttgcgcgcgcacgcggtgctgctggaacgcgccccgcgcacggccgggcattggctggccgtcgccgaggccgcggtgcgcgggccgctgcagatcgcggtggcctgcgaccccgcccgctcggcgctgctggccgacgcgcgacggctggcgcccggcggggcgatcgtggtgggcggcccgcgggattcatccgagctgctggccggccgcgaccgggtggccggcgccgacgccgcctacgtatgccgcggccgggtctgcgacctgccggtgacccgcacacccgaactggccgccgccctgggtgcgccctcgccctgaccgcgagataccctgcgtcgcatgccgaatgacgccaagaccgacgcgatcaggaacacggtccaccgctacatcgaactggtcgccaaaggcggcgccgacgacttggtcgagctgtacgccgacgacgccaccgtcgaggacccggtcggcggcgaggtacacatcggccgccaggccatccacggcttctactccgcgctcgacaacctgcagcgcgaatgcgagctgctgacgctgcgggtggccggcaacgaggcggcgttccacttccggctgaccgtgaccgcaggcgagcaccggatggtgatcgagccgatcgacgtgatggtgttcgacggcaatgggaaggtcgccgcgatgaaggcctactggtccccggacgacgacgtcagccggccgtaacccggacgatcagggcgtggccagccacgcatggtcgccggtgtagaacacggcgaaccacatggcgatgtagtgcaggatcgccgcgatcgcggtgagggcgtggaagaactcgtggtagccgaacgtgctaggccacggatcaggccagcgcagcgcgtagaagatgccgcccacgctgtagagcaccccgcccaccgccagcagcaccatcgcggccaccccggcctggtgcaggatcgtcggcgcataccagatggccacccagcccagcagcaggtacagcggcacccccagccagcgcggcgcggtcggccagcagaccttgagcgcgatgcccgccagcgcgccgccccacacgatgcacagcaccaccaccccggtgttctgcggcatcaccagccgggcgaacggggtgtagctgccggcgatgaacacgaagatcatcgagtggtccagccgcttcatccgggtgcgggcggcctcggtcttccacttcacccggtgataggtggcgctgaccgcgaacagcgccaccgtggccgcggcgtagatcagcgtcgagtgcccggcgcgcggcgaggcggccgcccacgacaccgacaccagcgtggcgccggtgatgacggccagccacgccgagtagaagtggatccagccgcgcatccgcggcttgcccagaacctgggcggcgccttcgaagagctgctcgacggtgttgcccgggacgatcgcctcgtgatcgggctccgggttgggggcggtgctggtctggctgctcatgtctcctgggggtggtctgccggatagggatgcaagggatgcggccggcggctgctcaccagtcagagtagccaggaacggccgcggcgccgtcgcgagctgtgcggcgacggcccgcacgacgcggccgaaatcagcaccggtgaaacgatcgccgctggcagtagggtgtgtgttcgtggaaatcattccgccgcgactcaaggagccgttgtaccgcatctatgagatgcggttgcgccaggagctcggtgccgcgaaggccgacctgccccgccacatcgcggtgctgtgtgacggcaaccggcgctgggcgcgcgacgccgggtacgacgacgtcagctacggctaccggatgggcgcggtcaagatcgccgagatgctgcgctggtgtcaggcagccggcatcgagatgaccacggtgtacctgctttccacggagaacctgcagcgcgaccccgacgagctggccgggctgatcgaaatcatcaccgacgtcgtcgaggagatctgcgcgccggccaaccggtggagcgtgcgcaccgtcggcgacctcgagctgctcggcgaggagccggcccgccggctgcgcggcgccgtggagtccaccccggtcgaggcgtccttccacgtcaacgtcgccgtcggctacggcggccggagggagatcgtcgacgccgtgcgctcgctgctgagcaaggaactggccaacggggcgacggccgaagagctgatcgacgcggtcaccgtcgatgcgatctcggaaaacctgtacacctcgggccaacccgatccggacctggtgatccgcacctccggtgagcaacggctgtcgggttttctgctgtggcaaagcgcctactccgagatgtggttcaccgaggcgcactggccggccttccgccgggtcgacttcctgcgggcgctgcgcgactacagccagcggcaccgccgctacggcaaataacccgccgcccggaaggccttaagcacccgtcgacctgcgtgccacacttggtgcatggctgcgctgtcggcggtggtgttcacgctgagcgcctggctgggcctgtatctggccgcccgcgatccgcgcaaacccgtgctggtgctggcggcgatcgggctgtgcgggttcgcgctcgtggtggggctggacgcggtccgcaccgccagtcccgcgcacgccccgctgctgagccgcgtcgagatctacctgacggcggtgcccggtgtggcctggttcgcggtgctcgtggagctgtcccggccccccgacggctggcgcagccgcacccgcgaggtgctgctggtggccggggtggcggcgctgacgctgctcggcgcggcgctggccggcagcgtggacgggccgctgcggcccggccactggctgatgatggcggcgatctcggtgtcgaccctgggcgcgatggccgtcgcgttgcgccggccgcggcggccccggccggccgtcgggctggctgtcaccgccaccttgttctttgcgctggccaacgcgatcctgatcattccgctgggcctggtgcccagctggcttgcgctggcctcgacgagctgcgacgtgctggggctcggcgtcgccgtcgcgctgtgggacgcgttcgacgaggggcacgcgctgcgcgccgacatgctgcgctcgttcgccggttcggtggcggtcgccgtgctgttcggcggccaggcgctgatcgggctggcggtgacccgcgccgatcccggcgcgcggaccgcgctgaccgtgctgctgttcaccagcctggcgatcgcgatcaccgtgcaggtgctcgcggatccgctggccgggctgctcgaccggctggcgttctcgaaatcgcctgcgctgcgggcggatcgggccgcgctgcggcacaccggcgcggcgctgccgctgcgccaggagcatccgctggacggcgtcgacgacgtcaccttcgccaggctcacccgtcgggcactcgggcactacggggatctgaccaagctggtcgccagcccgctgaccgcgttgccggtgatcgacgagcggctggccgcccgcggggcccccgaccagccgatcgagcgagccaccgagctcaaggccgtgctggccgacgccatcgcccggctcaagccgcgcgacggcggcgacttcgggaccaccgaggagtggcgccactacaactcgctgtatttcccctacgtcgtcggggtgcgcgcctacgcccagaacgccaccgcgtcgggcctggatccgacggctcggcaggcctggcagtggttcgtcaccgaggttccccagcgctcgttgcacaactggcagaacgccgccgcccggctgatcgccgccgaccttcgcgggcgggtcccggttcccagcgagtagaacgggtactgcagtcaccgcggtcgccggacggcacagcgctgtgccccgcgcccgtgaccaggccactagccgacacggactggcgcgtgtcaaatatttacccgctgacgggaatagccgggtgaaccagctggtcatacaactcgtggcagcagttggcagcgccacgagtcgatatggcagtgctccggcggcacgctcaaacctgttcgacaccaacccgccatcgcgaggagtaatcacatgagcactgtttccggggtatccggcgtcaccgtccggcccctctacgactcgaccgactcgctgttgcgtttcgcggtgcgcgccgacgccacgctgaccggattgtgcggtctggccgtcgccgtcgccgccgatccgctctcgtcgctgaccggcctgacgtccttccaggagtacatcggcggagccttcttcgtgctctacggcctggtggtgttcagcctgggcgcgctgccggacctgcgccgcgcgggtatcagcatcgtggcggccaacgcggtgttcacgctggccgcgatcgtggccgccggcgtgttgccgctgaccggcgccggagtcgccctgacgctggccagcgcggcctacacggcggcgttcgccgccgtgcaatacgcgggagtgcgccggctcgagacggcctgaccgccggccggcgccgggctcacagcttgcgcagccgcagccggttgatcgagtggtcggcgtccttgcgcagcaccagggtggcccgcggccgggtgggcaggatgttctccaccaggttgggccggttgatcgagcgccagatctcccgggccgcggccaccgccttggtgtcgttgagcgccgcgtagtggtggaagtgcgactcgggatcggcgaaggcggtgctgcgcatcgccaggaaccgcgagatgtaccactgctcgatgtcttcgatccgcgcgtcgacgtagatgccgaagtcgaacaggtccgacaccatcagggtgggcccggtctgcaggacgttgaggccctccaggatcaggatgtcgggatggcggaccacgtgcttggcccccgggatgatgtcgtatttcaggtgcgaatacaccggcgcgcaggcgtagtccgaaccggacttgaccgacgtcacgaaccgcatcagcgcccggcggttgtagctttccggaaatcccttgcggtgcatcaggtttcgccggtccagctcggcgttcgggtataggaacccgtcggtggtcaccaggtccacccgcgggtggtggtcccagcgggccagcagcgcctgcagcacgcgcgcggtggtcgacttgccgacggccacgctgccggccaccccgatgacgaacggcaccggccggtccgggttttgctgaggttcgccgaggaactcggcggtggcggcgaacaaccgctgccgggcggccacctgaaggtggatgagccgggccagcggcaggtagacctcttccacttccagcaggtcgatttgttcgcccaggccgcgcaggccgaccagttcctcctcggtgagggccagcggcgtggacatacgcagcgcacgccattgctttcggtcgaactccacatacgggctcggctcgctaagccgcggcatagtgcaagtgtggcaggggctcgcccgcgcccgacggcagggccggcgaaaagccggccctggatagactggcgccgtgactgctgcacctgacgctcgccccaccgcatccgacacggcgtcgctgatgtcggcgccgctcgccgacatcgaccccgacatcgccgggttgctgggtcaggagctgggccgccagcgcgacacgctggagatgatcgcctcggagaacttcgtcccgcgcgcggtgctgcaggcccagggcagcgtgctgaccaacaagtacgccgaggggctgcccggccgccgctactacggcggctgcgagtacgtcgacgtggtggagaacatcgcccgggatcgggccaaggccctcttcgacgccgacttcgccaacgtgcagccgcattcgggtgcccaggccaacgcggccgtgctgcacgcgctgatgacgccgggggagcggctgctgggtctggacctggccaacggcgggcacctgacgcacggcatgaagctgaacttctccggcaagctctacgacgtcggcttctacggcgtcgacccgaccacgcacctgatcgacatggacgcggtgcgggccaaggccctcgagttccgtcccaaggtcatcatcgccggctggtcggcctacccgcgggtgctggacttcgcggcgttcgcgtcgatcgccgacgaggtcggcgccaagctgtgggtcgacatggcacacttcgcgggcctggtcgccgccgggctgcacccgtccccggttccgcacgccgacgtggtgtccaccaccgtgcacaagacgctcggcggcccgcgctccggcctgatcctgggcaagcaggagtacgccaagtcgatcaactccgcggtgttccccggccagcagggcgggccgctcatgcacgtcatcgccgccaaggccgtcgcgctcaagatcgccggcacggaagagttcgccgaccggcagcggcgcaccctgtccggggcgcgcatcctcgccgagcggctgtcgggcgccgacgtggcggccgccggcgtgtcggtggtcagcggcggcaccgacgtccacctggtgctggtcgacctgcgcaactcggagctcgacggccaggccgccgaggacctgctgcacgagatcggcatcaccgtgaaccgcaacgccgtgcccaacgatccccggccgccgatggtcacctccgggttgcgggtgggcacgccggccctggccacccggggcttcgggggcgccgagttcagtgaggtcgccgacgtcatcgccaccgcgctggcgggcggccgcggggccgatctggcggcgctgcgggaccgggtcacccggctggccagggatttcccgctgtacgagggcctcgaagactgggcgctggtcggccggtagccggccgctggggaccaaagtcaccactttgcccgcggcggcgcggacgatttcacgaacctgtgtacgcaagttacagttatctccatggccgaaagacctgtcgctaatgcgctgaccctggaactcgagccggttgtcgaagccaacatggatcggcacctgtccaccgaggaactctggttcgcccacgactacgtgccgtacgaccggggtgagaacttcgccttcctcggcggacgcgactgggatccgtcgtcggccacgctgccgaggccgctgacggacgcctgcgagatcatgctgctgctcaaggacaacctggccgcacaccaccgcgagctcgtcgagcacttcatcctcgaggactattggggccgctggctgggccggtggaccgccgaggagcacctgcacgccattgcgctgcggaattacctggtggtgacccgcgaggtcgacccgaccgccaacgaagaggcccgcgtgcagtacgtgatgaagggctaccgcgccgacacctacagccaggtggagaccctggtctacatggccttcaccgaacgcagccacgccgtgttctgcgagaacctgtccgcaaagctcgaggagccgatcctgtccgggttggtcgaccggatctcccgggacgagcggcgccacgagctgttcttctccaacctcgtcgcgcactgcctggaatacacccgcgacgagacgatcgccgcgatcgccgcccgcgcggccgagctgcaggtgcccggcgccgacatcgacgcctaccaggacaagctgcgcaacgtcgccgaggccggcgtcttcaccgagaatgacctgcgccaggtgatctccgaccgcatccgcgcatggggtgtggccgacgagcccgccctcaagccgttcgtcatcggctgacccttcttcgcgcgccggcgcgcacccgtcggcgcgcctgcgctgctgcgcagcggccacgagagtagcgtcgttctcgatggccagcgtcatgctctgctgccagggcggcacctcccgtcaccacaacggaaggaccggccccggtcctggtgctgcggttcccgtcgacatgcctgcgcgggtccgcgcgggctcatcccgctcgaggagcgctacgtgaccgatatccggacctacgtgatcgacacctccgtgctgctgtccgacccgtgggcgtgcagccggttcgccgaacacgaggtggtggtcccgctggtggtgatcagcgaactggaggccaaacgccaccatcacgagctgggatggttcgcccgccaggcgctgcgtctgttcgacgatctgcggctgctgcacgggcggctggatcagccgattccggttgggacgcaaggcggttcgctgcacgtcgagctcaaccacaccgacccggcggtgctgcccgcgggtttccgcagcgacagcaacgactcccggatcctgagctgcgccgccaatctggccgccgagggcaagcgagtcaccttggtgagcaaggacattccgcttcgggtcaaggccgccgcggtggggctggccgccgacgagtaccacgcccaggacgtggtggcatccggctggtcggcgatgcacgagctcgagaccgcggccgaggacatcgacgcgctgttcaccgagggcgagatcgacctggcggaggcgcgagacctgccgtgccacaccggaattcggctgctcggcggaagctcgcacgcgctgggccgggtcaacccggacaaacgtgtgcagctggtccgcggcgatcgggaggcgttcgggctgcgcgggcgttcggccgaacagcgggtggcgctggacctgctgctcgacgagtcggtgggcatcgtgtcgctgggcggcaaggccggcaccggcaagtcggcgctcgcgctgtgcgcgggcctggaggcggtgctggaacggcgcacccagcgcaaggtggtggtcttccgtccgctctacgccgtgggtggtcaggagctgggctacctgcccggcagcgagagcgagaagatgggcccgtgggcgcaggccgtcttcgacaccctcgaggggctggccagcccggcggtgctcgacgaagtgctgtcccgcggcatgctcgaggtgctgccgctgacccacatccgcggccgctcgctgcacgactcgttcgtcatcgtcgacgaggcgcagtcgctggagcgcaacgtgttgctgaccgtgctgtcccggctgggcaccggctcgcgggtggtgctcacccacgacatcgcccagcgcgacaacctgcgggtgggccgccacgacggggtcgcggcggtgatcgaaaagctcaagggccacccgctgttcgcccacatcaccttgctgcgcagcgagcggtcgccgatcgccgcgctggtcaccgagatgctcgaggagatcgccgggccgcactgacggcgcctggtttcgcagggctcgctcgtaacgccacggcgattccggggcccggtttgcgccctgccgttacgagcggcggcctcgccgccccggggtgtacgcccgctttcgataaacttccacggtggcgaaacgacccgacaccctggcctggcgctactggcgcacggtcgtcggggtgctggcggccgtcgcggtgctggtgatcggcgggctgaccggccacgtcacccgcgccgacgacctgagctgctcggtcgtcaaatgtgtggcgctgacgttcgacgacgggcccggcccgttcgacgagcggctgctgcagatcctcaaggacaacgacgccaaggccaccttctttctgatcggcaacaaggtggccgcgaacccggccggcgccaagcgcatcgccgatgcgggaatggagatcggcaaccacacctgggaacaccccaacatgaccaccatccccaccgaggacatcgccgcccaattcaccaaggccaatgacgcgatccacgccgccaccggccgcaccccgaacctgtaccgccccgccggcgggctgtccaacccggtggtgcgtcagaccgccggtcaattggggctggccgaaatcctttgggatgtaatccctttcgattgggccaatgactccaacaccgccgcgacgcggtacatgctgatgacctacatcaaaccgggctcggtggtgttgttccacaacacctactcgagcaccgttgatctggtgtaccagttcatcccggtgctcaaggccaacggctaccggctggtgactgtcggcgaactgctggggccgcgagcgcccggcagcagttacggcagccgggagaacggcccaccggtcaacgggctgcgcgacatccccgcctccgacatccccaagctgcccgacacgccctcgccgaagccgatgcccaacttcccgatcaccgacatccccgggcagaactccggcgggccgaacaacggtgcctagcacgcgggcagctgcagaggagcgaaagtccgctcggcggtggctgtttcgctacgggctggacatgagcctgtcgtatgtgctggccgtcggcgaagccgcggccatcctgatcccgttgcgcggccacacgtccgtcggggtcaacgccgacttcgcgcggcagaacaccgggccggtgctggcgctcatcgcgctgggcatcatcggcgtcgcggtggccggcgcgctgagcctggctcccacgctgcgctggtatgtcgcgggcgaggaacccacgccgcagcagcgcgacgcggtgatgaagctggccggccgccagtcggcgatcctggtgaccgcctgggcggtgagcggtgggatcttcctgctgctgaatgtggctgggggagcacgacttctgctgcccatcgcgctcggcgcgttgctgggcggctcggccgccgccggcaccgggatgctgctcgctcagcgcactttgcggcccatcatgcgggcggccacgctgggcgccgagccgcggctggcggtgcccagcgtgtacgcgcggctggtcctgctgtggttcctgtgcagcgcgtttcccatcgccgtcatcgcggccttggtggtgctgcgctcgtacggctggttggtcgagaagtccgcgtcgctggatgtgcccatcctggtggtgtcgctggcggcgctggtgctcgggctgccgacgatgatcttgacgtcgcgctccatctccgatccgatcggcgaggtcgtcgatgcgatggccgagattgagcacggccggatggagacctacgtcggcgcctacgagcgctcccaaatcggcaggctgcaaacgggtttcaaccggatggtggctgggctcgccgagcgtgaccggctgcgcgacctgttcggccggcacgtcggcgcggacgttgcgcagcgcgccatcgaagagggggcgtcgctgtccggggacgtggtggaagcggcggtgctgttcatcgatctggtcggctccacccagctcgcggaaagccgccccccgcaagaggtcgcggaggtgctcaacgacttcttccggattgtcgtcaacgccgtcgacgaacaccacggtctggtcaacaaattcgccggcgacgccgcgctggccgtcttcggggtgccgttgccgaccaatcagccggcgtctgcggcgctggcgacggcccgcacgctcggtacccaattacggcagttgccagtcgatttcgggatcggtgtgtccgcgggccgggtcttcgccggcaacgtcggcgccgagaaccggtacgaatacaccgtgatcggtgacgccgtgaacgaggcggcgcggctggccgacctggccaagaccgccgaccgcagaatcctgtgttcggcggcggcgatcgaggcggccggcgaagccgaacgcggacactgggccgaatgctattccaccgtgctgcgcgggcgatccgagaccacccacgtctcggcgcccaccggttaggacttcgcgaccttcagcgcggcgatgatcttgccgatcagtccggccgaggcgctgtcaccgatcggtgtgctgccgatgaacacgctgacgggtttggtgtcgaccgcgatgatggtgaccgaatcgcccttgacgttgcgggtggggtcggcgatggtgacgtcggcgtcggcccggaccgccttggtgccgtcgacggtgatcggtgacgtcttgatcgggcccagggtgggcatcgcgttcgcatagccgggcccgttggccaggcactgcatcagtttggtggcctgcgcggtgaggtccatgctggggacgaagttggtgacgccgacctcggcggtcatcatccactggttggcccccggcacatcctgggccacgcccagcgcaccgatcaggttcgggccctggtcgtcggagaacaccgtccaccccgacggcgccgcgttggccgggaacgaaagcttgcccgcggcgatggagtcggaccggggcatgtcgccgccggacacgttcggggtgcaatcggtggcgttctgcgccgagttcttcggctgcgacaccgaggtgctggtggacgacggcgtggcgccggacggcttgctgccgtgcccgcccttcatcaccaccagggtggccaccagcgcgatcaccgccagcacgaccagcccggcgacgatcagccagggcaacttggagccggggccgccgggcggcggtcccggcgagtagggcccgccgggcccgaacggctgtccgggaccgggatacggcgcacccgggtacgggccgcccgggtaggggccacccgggtacgggtagccgccgcccggcggcgggtagggatacggaccgccggccggatactgcccgggctgcggataggggccgccctgtggctgaccgcctggtggctggccgcctggtggctggccgccccaattcggctcctgcccatacggattgcttccgtaggaccccgggccgtagataccgccgggaggagccgtcatcgaaaaaccatccttactgtcatcaaccgccgtcaccgaacggtcggctcagtcctgcggcttgaccttggccatggccagcacgtcgagccggcggtcgagctcctcgagcgacagcttgtcgccgatcagcccgcggtcgatgacggtctgccgaatcgtcttgcgctccttgagcgcctgcttggccaccgccgccgcctcctcgtagccgatcgccgagttcagcggcgtcacgatggacggtgaggattcggcgagctcgcgcaggtgctccacgttggcgctcagcccgctgatgcagcgctcggcgaacagcctcgacacgttggtcagcagcttgaacgactccaggatgttgcgggccatcatcgggatgtacacgttgagctcgaaggcgcccgacaagccgccgacggccaccgccgcgtcgttgccgatcacctgcgcggcgacctgcgtaaccgcttcggggataaccggattaaccttgcccggcatgatcgagctgcccggctgcagatcgggaagggcgatctcggccaggccggtcagcggccccgagcccatccagcggatgtcgttggcgatcttggtcagcgacaccgcgatggtgcgcagcgcgccggaggcctcgaccagcccgtcgcgcgccgcctgggcctcgaacgagtttgtcgccgtgcgcaattcgctcaatccggtggaggcgatcagcgtctcgaccaccttggcgccgaagccgtcgggagcgttgaggccggtgcccaccgcggtcccgccgatcgccagctcacccagccggggcagcgtggcccgcacccgttcgatgccggcctcgatctggcgggcgtagccgctgaactcctggccgagtgtcaccggcacggcgtccatcaggtgggtgcggcccgacttgaccacggtgtgccactcgcgggccttgctcgccagggcgtcgtgcagcacctgcagcgccggaatcagatggcgcactgcggcttccgtggccgcgatgtgggttgcggtggggaaggtgtcgttcgacgactgcgacatgttgacgtcgtcgttaggatgcacggtcaccccgttggcggccgcgatggacgcgatcacctcgttggtgttcatgttcgagctggtgcccgagccggtctggaagacgtcgatgggaaactggtcgtcgtggcgaccgtcggcgatctcggcggccgcggcgatgatcgcgtcggccttctccggcgccagcagccccagatccttgttgacctgcgcgcaggcgcccttcagcaggcccagggcgcggatctgggtgcgttccaggccccggcccgagatcgggaagttctcgaccgcgcgctgggtttgcgcgcgccacaacgcttttgcgggtacccggacctcgcccatggtgtcgcgctcgatgcggtagtcggtgtcgccgtcgtcagtggccatacagtggcttcctcgttctcgggtcggttctcagggcaggggataggcggcagagctgtcgccggtgaagtcgatggcggagtactcgttgagcttcgacagccggtggtaggcctcgatcatccggacggtgcccgacttcgatcgcatgacgatcgactgggtggtgcagccgccggggtagtactgcacacccttgagcaggtcaccgttggtgaccccggtggcgcagaagaagacgttctcaccggagaccaggtcctcggtggtcaggatctggtccaggtcgtagccggcgtcgatggccttctggcgttcctcgtcgtcgcggggggccagctgcgcctggatggcgccgcccatgcagcggatggcggcggcggcgatgatgccttccggggtgccgccgatgccggccagcatgtcggtgccggagtgcgggcggcaggccgagatcgcgccggccacgtcgccgtcggtgatcagccggatccgggccccggtctcgcggacctcgtcgatgagcttcgcgtgccgcggccggtccaggatgcacacggtcatgtcgcgcaccgacagggccttgaccttggcgacggccttgatgttctcggcgatcggcgcggtgatgtcgagcacgtgcgcggcctcgggcccgacggcgatcttgttcatgtagaacaccgccgacgggtcgaacatggcgccgcggtcggccaccgccagcacggagatggcgttgggcatgcccttgctcatcagcgtggtgccgtcgatcgggtcgacggcgaagtcgcattccgggccgtcgccgttgccgacctcctcgccgttgtagagcatcggcgcgtggtccttctcgccctcgccgatgacgaccacaccgcgcatcgacaccgtgttgaccagctcacgcatcgcgtcgacggccgccccgtcaccgccctctttgtccccgcggccgacccagcggccggcggccatggcgccggcctcggtgacgcggaccagttccaacgccaggttgcggtctggtgcctcgccgcgcggccggccctgcgccggggcccggccggtggcggcggacgagcggtcgccctcaactgtcatggttgctgattgtcccagaagcggatcggtccgcgagaactgggatacttggaggatgaccgagcagccgtcgctgaatgccagctcgccgggcgagtctgccgcggcggccgggcccgttcccaggccggagaaaccgcggctgctgcaggacggccgcgacatgttctggtcgctgataccgctggtgatcgggtgtgtcgtgctggccgggctgctgggcatgtgttcgttgcagctgcacaacagaccggggcccatcccgccctacgacgccgcggcggccctgcgggcggacgccgcgacgctgggcttccccgtccgccaaccggcgctgccggctggctggcaggccaactccggccaccgcggcggcatccagaacggccggaccgacccgtcgaccggtcaacggctcaatgcccccacctcggtggtcggctacatcagcccgaccgggatgtatctgagcctgacgcagagcaacgccgacgaggacaagctgatcaactcgattcatccgtcggcctacccgaccggaacggtcgacgtcgccggaaccagctgggtcatctatcagggttccggtcaaagcggcgcggacgccgagccggtgtggacgacccggctgaccggcgcgggcggcgccacccagatcgcgatcaccggcgccggaagcgccgagcagtttcgtacgctggcctcggcgacccagtcgcaaccgccgttgcccgtgcgctgacgaaaggccgagcatgactgcaccagaggctgatctgtccggctggtcggtggcaccgttcagcggtggcggctacacccacgacgtctaccgcaagggcgtgggcccgggcgtggtgctgattccggagctgccggggattcatcccggggtgctggccctgggtaatcatttggtggacaacggtttcacggttgcgatgccgtcgctgttcggtgagccgggcaagccggtttcgccgggctacctcgtcgcgggcatgacgagggcctgcgtggcaagggaattcgccgcgttcgccaccaacaagcagcggccggtgtcgttgttcctgcgggcgttggctcgtgacctcaacgcgtcgacgcccggtgacggggtcggggtgatcggccaatgcttcaccggcggtttcgcgttggccgccgcggtcgacgagagcgtgctggcaccggcgctgtcgcagccgtcggtgcccttcccgctgggcgcgacgcggcgccgcgaccccggcgtgagcgaggccgagctggccaccgtggccgaccggtgcgccaatgagggcttgtgcgccatgggtttacggttcagcgaggactggacgtcgccgcgtgagcggttcaccgcactcaagcagcggctcggcgacgccttcgaggtgatcgagatcgactcgcgcccgggcaacgaacacggattcggcaagacggcgcactcggtgctcaccctggaggtccgcgaagtcgacggccaccccgcctacgaggcccgcaagcgggtggtcgaattcctcacccagcggctgggcgcgcgctaggcgaactgcctcgggccgcgcggctcatcgaccataatgaggcgacgctgttttcagtttcttccaggaggttttgtgcgcatggcggtcgatgacctcgtggtggaaaccggttacggcccggtccggggcgtcgcagccgacggtgtcaaggcgtggaaaggcattcgctacgcggcgccgcccatcggcgacctgcgcttccgcgcgccccagccgcccgagcggtggaccgaggtggccgacgccaccgtcttcggcccggcctgtccgcagccggtgttcccgaacatgccgctggatttgggtgcgccccaaggcgaagactgcttgcggctcaacgtctgggcatccgccgacacccaacccggggacgccaagccggtgatggtgtggctgcacggcggcgcctacgtgctggggtcgagcagtcagacgctctacgacggccgccggctggtcagccacggcgacgtcgtggtggtgacggtcaactaccggctcggcgcgctcggctttctcgacctgtcgtcgctgaacagcgcagggcgcagcttcgactccaacgtcgggctgcgcgacgtgctggcggcgctgaagtgggtgcgcgacaacatcaccgcattcggcggcgacccgcggcgggtcaccctgttcggcgagtcggcgggggcggggatcgtcaccacgctgttggccagccccgccgccgcgggcctgttcgccgctgccatcgcgcagagttcgccggccacctcggtgtacgaccgtgaccgcgccggccgtgtcgccgaagccttcctgggcaagctgggcatcaccgcatcggagtcacgacggctgatcgacatgccgatggcggcgatcctggccgcctcccagcaggtgttcgacgaagtgccggtgcgcaatccggggacgctggcgttcgtcccgatcgtcgacggcgacgtgctggccgactatccggtgaaggtggcacaacagggcggctcgcacccggtgccgctgatcatcggtaccaaccagcacgaggcggcgctgttccggctgatgcgctcggcgctgatgccgatcaccccgcacgccatcacctcgatgttcaaccagatcgccgccgaacaacccgacttgcagctgcccaccgaaaagcagattggctccgcctattcccgattccgccgcagggcaaggtatttgagcatcgccaccgacgtgggcttccggatgccgtcggtgtggctcgccgaggggcacgcccgggtggcgccggtgtatctgtaccggttcgactactccaccccgctgctgaggctgctgatggtcaaggccgcgcacgccaccgaattgccttatgtctggggcactctcggtgcgcccaaggatcccaccctcaagctcggcggcagcaagaccgccaaggcggtgtccaagcgggtgcggacccgatggatcaacttcgccgcgcacgcgaaaccggcgggccccgccggcagcccggagtgggcgccgtatcaggagcaggaccgcgcctgcctgatcatcggcaagaacgacgtgctggcccacgacgtggacgccaaggcccgtgccgcctggggcagtgagatggtcagcttccgctaggcggatgccttgcccgccaaggcttgtcgcttcatctgttcgaacatgccgacgtagtacggcaggcattccgacatcgcctgctcggtggtgaacagcggctgatagccgaggtcgcgcgaggccttggcgatggagaagaagttgtccagatacagccgctcgaccgcgagcggctcgagcagcggcgccgggatcccgaacctgaaatgcagccgctgccaacccgtcatcgccgcgcgcacgatggggccgttgacccggacccggggccagttcacgccgcaggcctcgaccaccggccgggcgaactcgaacatgttgatcggctcggcgtcgttgatgaagtacgcctgaccgggcgcggtgccgccgggcgtcaggtgctggtccgccaggatgaaaccgtgaatcaggttgtgcacgtaggagttgtccaaccgggcggatttgcggccgatcagcaccttgacgtggccggcgatcacgctttcgaacagcttgcggaacatggtttggtcgccccggccccagatgccactgggccggatcgcacacgtcagcatgccgtcaacgccgttctggcccaagacgaatcgctcggcgagcaccttggtctcggtgtagaggtcgttgaaccggtcggtgtagggcaaggtctcgtcgccgccgacgatgttctggccgcccatgacgacgctgttcgacgaggtgtagacgaagcgctgcacgccggccgcctgcccggcacggaccaggttctcggtgccgccgacgttcaccgcgaagctgcgctgccggtactcctcggtgaccgaggcgccgcccatcaggtcgatgatcgccgcggtgtgaaagatcgtgtcgatgccctcgaccacggcggcgcacacaccggcgtcggtgatgtcgccctgcagcacctccaggtgtgggtgcgccggcagcggcgagggggcgcggtcgaaggagcgaacctgatatccgcgctcgagcagggtggtcaccaggttggcgccgacgaacccggagcccccggtgaccagaacgcgacccagttcggccgtcagcgatggatcacccatggggccgatcataactgaaacgtgttccagtttcgaaaaagtgtggcaacgaagctctccaatagggtcgaattcagtcgtcgtcagcctcgcccgcggcgagggcgtcttcgattcgcttgcgcgctccagctaagtgctcttcacagcgtttcgccagctgctcgcctctttcccacaaattcagcgatgcatccaggtccaggccgccctgttccagttgccgcacgacctcgatcagttcgtcccggcacgcctcatagcccagtcgactaataggtgtagccgcggcggcctgctcgtccttcttgttattcgccatcggtcggtccctcgctcagcgccgccacggcgccgtcggcgacccggacccgcagccgggtgcccgccggcgcgtcgcccaccgaacgcagcacgtgagggccgccggcgccgacggtctgcaccacggcgtaaccgcgggccagggtggccgccgggcccaacgtcgccagccgggcgcgcaggtggccgatccgctcggtttcggcggcggtcaaccgggtgacgtcgtgccgaatcgccgaccgggcacggtgcacctcctcggcgcgtgcggtcaacgcccgcaacggctcggccagcaccgggcggctgcggatctgcgccagcgcgcgttgctcgcgagatacccagttgcgcaacgcctgtgcgctgcgccgccgcaggtcgtcgatcagccgctgttcggccgcggtgtcgggcaccaccttcttcgcggcgtcggtgggggtggccgcgcgcacgtcggcgaccagatcgcacagcgggttgtcgggttcgtgaccgaccgcgctgatcaccggggtgcggcaggcggcgatggcgcggcacagcgtctcgtcggagaacggcaacaggtcctccacgctgccgccgccgcgggcgagcacgatgacgtcgacctcggggtcccggtcgagttcgcgcagggcctccacgatctgcgcgaccgcgttgggtccctgcaccgcggtgttgcgcaccgcgaaacgcaccgcgggccagcgccccgccgcgacggttttcacgtcccgctcggcggcgctcgcccggccggtgatcagcccgatcatgttgggcaggaagggaattggccgcttgaggcgggggtcgaaaagcccttcggcgtccagcagccggcgtagccgctcgatgcgggccagcagttcgcccaccccgacggcgcggatctcggacagccgcagcgaaaacgtgccccggcccgtgtagaacgagggcttgccgcacacgaccacctgggtgccttcggccagtttcaccggggcgttgagcaccaggtcgcgcgggcaggtcacggtcagcgacatgtcggcggccgggtcacgcagcaccatgaacacggttttggagtccggccgcagcgacacctgggccagctgaccctccacccacaccgtgcccagcctgtcgatccagcccgcgacccggattgccaccgcgcgcaccggaaatggattttcggcggagttcggttcggaggtagcggctcgggtcacttcgcggtcgcgcgggtgatcctgttggccagcagcgtctgaaacggcgcccggcccttggtggcctgctcgtaggccagcagcgcctcgagttcgtccacgctcagcgattgcagccgggcccgcagctgggccagcgtcagcgctgagtagtccagttcggtgaccaccgccggtgtcgggaccgacgcctcggccgccggcttcgcggacgggcgggccgacctggtcagggcgctggcgtcgtcgtgcgcgtcggccaccgagtagagcgcgaatcggccctcggcccggcgctcgccctcactgccgtcggccgggttggcgtagccgtcggccgcgtcgtcgatgtcctcgtcgaaggtcgcccattccggcttctcgtccttgggcgggaagatcgattcgagggtgctgtcccccttgatcaccagctctgcgaggttctgctgaaagcgcatcacgatgtgggcggcctggctggccagcgtcatcggatacatcaggatggttttcggcagccgcatggtctcctcaacggcgactgtcgccgcgccgaccagcagccgaactccatacggtgcagtagccatgggtccaagattgcctcaagcggcggctaactccaagcccgccggcgcgagctggcaagcccgtgtcggcagaacgtaccctggatgccatgccgccgaccgtcgacatggggattcccggcgcatccagctccgtagccgtcaacccgacccgcaagcgcgtgctcctggccgagccgcgcggatactgcgcgggcgtggaccgggccgtggaaacggtggagcgcgcactggagaagcacggcccgccggtgtacgtgcgccacgagatcgtgcacaaccggcacgtggtcagcaccctggagaaggccggcgcggtgttcgtcgaggagaccgacgaggttcccgaaggggcgatcgtggtgttctccgcgcacggcgtggcgccgacggtgcacgccgcggccgccgaacgcaacctgcacaccatcgacgccacctgcccgctggtgaccaaggtgcacaacgaggcgcgccggttcgcccgcaacgactacgacatcctgctgatcggccacgagggccacgaggaggtggtcggcaccgctggggaggcgcccgaccatgtgcagctggtcgacggggtggccgcggtggacaacgtgagggtccgcgacgaggacaaggtggtgtggctgtcgcagaccacgctgtcggtcgacgagaccatggagatcgtcgagcggctccggcagcggttccccaagctgcaggacccgccgagtgacgacatctgctacgccacccagaaccgccaggtggcggtcaaggcgatggcgccggaatgcgacctggtgatcgtcgtcggctcgcgcaactcgtcgaactcggtgcggctggtggaagtggcgctgggcggcggggccggtgcggcccacctggtggactgggccgacgacatcgaccccgcgtggctggaaggcgtcaccacggtgggcgtcacctcgggcgcgtccgtccccgaggtcttggtgcaaggcgtgctcgagcggctggccgagtgcggcttcgacgtggtgcaaccggtgacgacggcgcaggagaccctggtgttcgcgttgccgcgggagatccgctcagcgcgctgatcgcctcaggctgacgccacgcgtcaggcgtcgtactcccaggattccgtcggcggccgaccctgcgtccggcccggcgtccgcgaacgggtgcggcgctcggtgtgcggttcacgcggctggcccggcgcggcggcgccgcggtagcggacctgcgagatggggtgatgcgtcccgttggcgccggtcgacgcggggcggcggcgccggggctcatacggcggctcgggggtgtcgtagcggctgtcgtagcggcccaggttctccggcccgctcggcgggtcgtagccgtcgaaacggctgctgcgcggcacgggccgttcgtagggactgcgccggggccgcggctcgcgacgcggctcgcgcggtgtttggccgcgcagctcggggtcggcgtcgggccgggggcggcggcgcgtgcgccgcggcggctcggcggcgtcgtagttgcggccggcggtgtcgtagttgcgcgccgatgccgcgctgcgccgggtggcgcgccgctgccgttcgggacgttcggccggttcggcggcgtcgtccagcggcgggcgcgcatgccgggagcgggtacgcgaactgcttgccgacgagcgagtgctgcgcgcggtgcgccgcgttctcgacgacgagcccgaccggcgggtgcggcgccgctgtgcgctctcctcggtggtatcgccgtcggagtcggggtgcagcgccgcccgcaccttggccaccaggccgccgacgagggactggacgtcgacactggggccggcggcggcgtcgtcggagccggccgccgtcgtcgaccgttgaccgtgcccgaaataccagcggaccaagccgatcgccagcacggcgccggcggtacccagcatcagcgggaaccgctcgatcagcggatagccgcagttgatcagcaggtctttgagccggcccaccttggcgtcgtggaacaaccagtaggccccgggcaccgcgcagaacaggatcagcggcggctggatgatcgtggtgaagatgccgtcctggcgcaccgccagcaccgccgccacgcaaccggctatatagaagcccgcgaagacgtgggtcagctccttgtgaccagcgtcgattccatagccgatggcggtcgcggtgacggcgacaagcacggccgcgtaccaggggaggcctgggatgtttgggtggatcgaatggtgggcgctctccaccgtcgaacttgcccgctgtgctgacacatgtagaccgtaccgggaatggaccgaaaggctcgtaaatacctcgtagcgatcgcgggcgtgccacggcgcggcgcaggaatggtcgcccggtcggtcgccggcgccgggcccctagacttgattccctgtgagcctgagcctgggaatagtgggcctgcccaacgtcggcaagtcgaccttgttcaacgcgttgacccggaacaacgtggtcgcggccaactatccgttcgcgacgatcgagcccaacgagggcgtggtgccgctgcccgacccgcggctggacaagctggccgagatgttcaagtccgagcgcatcgtggcggcgccggtcaccttcgtcgacatcgccggcctggtcaagggcgcctccgagggggcggggctgggcaacaagttcctggcccacattcgcgaatgcgacgccatctgccaggtggtgcgggtgttcgccgacgacgacgtcacccacgtcgccggtcaggtggaccccaggtccgacatcgaggtcgtcgagaccgagctgatcctggccgacctgcagacgctggagcgcgcggtgggccggctggagaaggaggcccgcacctccaaggagcgccggccggtctacgaggcggcgctggccgcgcaggagacgctgaacgggggcaagacgctgttcagcgcgggcaccgacacctccctgctgcgcgagctgaacctgttgaccaccaagccttttctctatgtcttcaacgccgacgagtcggtgctgaccgatcccgcgcgcatcgccgagctgcgcgagctggtcgcgccggccgacgcggtgttcctggacgcggccatcgaatccgagctgatcgaactcgacgacgagtcggcggcggagttgctggagtcgatcgggcagaccgagcgcggcctggatgcgttggcgcgggccggttttcacacgctgaggttgcagacgttcctgaccgcggggcccaaagaggcgcgggcgtgggtgattcaccagggtgataccgcgccgaaggccgccggggtgattcacagcgacttcgagaagggtttcatcaaagccgaaatcgtctcctacgacgacctgatcgccgcggggtcgatggcggtggccaaggccgccggcaaggtccggatggagggcaaggactacgtcatggccgacggcgacgtggtcgagttccggttcaacgtgtagctcggcgccgccgccgagcgtgggggatatgcacgcagctggtgcgattttcgtacgttagacccacgctcgacgatgcgattgagcagccgctcggttgcgacgtggtatctcgccaaaaggccgaaaccactcgtaatgctttgctacagtccggttcgctaaacggaagactctgcaaagggatgcttgactcggcatggaagctttcgtaacgatcgtcttaattgggcttgcggccatcgtcctgtacagggtcattctgtacatcctcaaggagcggtacttcgccagcgaggaattcctggcccacaagaaaaagatcgcatcggtggtcgccgagcacaacgaggtcgccgattacgtctcggagatccgcagcggtgggtcgttcaggcttggcgcgtcatctgccggcgcccaagcacatctggcgtcttttcagaacaccagccattggaattaccgccgggaccggaacgtagcgaattacgaagcgccggacgtacacaactgttccctacaggttgtccgcaacgccaaggccgatcccctcaagtacgtgatgaagtactttggaattaaagctgacgaggcccatctcgccgaggtggaaaacttgggcgatagcatcacgcgactggaagatgcggtcaacaaccttgcgcagcgcgaggcgagcatcaccaagtctttcaatccgcctgcgttcatcttgaagcactacttcggtgagtttatgaaacacgtcggtgttgagttgtccccgatcagggttccgtatcctgtgtacgtctttgagtacgtcagtgccggcggaaatagttcgcagcgcacaaccgtcacgttggacaccccagcgatcgacgcgctcatcgagacactgtcgcagaagattcgctggagaaagagtgctgccggccagcgggcgctaatgacctcgaggctgcgcaactccataaaggtgcgtgatcattacacctgccggtactgctcggtgtcgctcgcggctgaacctcacctacttctcgaggtggaccacatcgtgcccatttccaagggcggcatgtctactcccgacaatcttcagactctgtgctggcgctgcaaccgcacgaagtccaacaaggtcgcgaccgcctgacggcttgctgcatacgttcccggaggcggtgtgaagggacacccgaagcatcgtttggttccggttcaacatcgatctcgatacctgttcaacagtcgtcgtgcgtcgctatgccgcttaaagtgtggcatcattggatgcatcaatgatgctcatggaggtgtctaaatgaggacgacggtgacgattgacgacgccttattggcagaggcggccgaactgaccggggtgacagagagcgtggcgctcctccgtcagggactgcagacactcgttcgggtagagagcgcccgtcggctggcggcgctcggcggcacggatcggaaggcatcggtcggccctcgccggagggcacccgccgatgattctcgttgacacgtcggtatggatcgatcatctgcacgtcgccgacaagcgactcatagagttcctgaccaacgacgcaatcggttgccaccaaatggtgatcgaggagttggcattgggtgcgatcaggcggcgcgccgatctattgcgcctgctgtccaatcttcgggcgttcccgttgttgacgcatgcggaggtccttcatctcgtcgaatgccaccgcttgtggggccgcggactgagtgcgatcgacgtccatcttctcgggtcggttgctctggtcgacggtgcacggctatggaccagggacaagaatttaaaagcggcgggctgggacgtgggtatcgcgatcgtcgacgagctctgacgttgcgtcgacgccctcgccggtaggcgtccgacgcacttcagaacaccgttgttggaacgctggagaagtgcgacgccactgacgagactgacagttatgagtttcgtagaggaaaaactgctcccacaggtgctgcgggtgcacgacacggtctaccgcaagaccaacggctggatcggtcaccgcacgctgtggataccgagcctgctgctgcacaccgtcggcgccaagaccggcaaaccgcgcaccacgtcgctgacctacgcccgcgacggcgagaactatctggtggtcgcgtccaagggcggtgcgcccgaggcccccggctggtatcccaacctcaaagccaagccggaagctgaaatcaacgtgggcccaaagcgtttcgccgtcaccgcgcggatcgtgccgcccggcgacgctgactatgcccggctctgggagatcgtgaacaagaacaatcagaaccgctacgccgaatatcagaagcggacgtcgcgcccgatccccgtcgtcgtcctgacgccgaaaagctagcgcacagcaacattcggtacccgatgcgcccggcgaagcggaggcttcacgtcagatggctccgttcatcgccgccgccgtggagatctccgatccgcagcatcccgcgcgcgtgcgggcccgcgagtacaagacctccgtcgccgcccgcctgagcgagaccgcccgggaggccggcgccgccgatccagaactcctcgctgagcagctggcgctgttgctcgatggcgcctcggttcggaccagggccttgggcaccgacgccttccggacggctgccgggatcgcggccgccctggtcgagcgcgccatacccccgacggcacggtgaatctcgcgcctgccggcccgacaaaacggccgctcggttgtcagaggcagcgcctaatgtgcttgggcgacaccacatccaccccttcgaggagcacccgcatgaagttcgtatcgacccgcatcatcaccgccgacgtgcagcgcctcgtcggtttctacgagatggtcacccgagtctcggccgtgtgggcaaacgagctgttcgccgagattccgacaccggcggccacgctggccatcggcagcgaccagacggtacccctgttcggtgccggatccgccgaacccgcggccaaccgcagcgcgattgtggagttcatcgtcgatgacgtcgacgccgaatacgagcggctccgcgagcagctcaccgaggtcgtgacggagccgacgaccatgccgtggggcaaccgcgcgttgttgttccgggatccggacggaaacctggtcaacctgttcactccggtgacgccggaggcgcgggccaagttcaaagtatgagccctagaacccgacgactccgaattgccacttgccccgaacctcgccacgggaaagtcttagggcatgacgacggaaaagcgcacggcgggttgggcggcgagcgtggcggcgggcggcgcgttggcgatgaccgtcgtcggtctcgccggcggccccgtcgccgcggcgggcccggcccccgcacccaccgggcattggtgtccgggcgatccgtggaacccgtcctggggcaacgtcttggactgggactggcatcaatgccacgattggcaacaccccggtggccccaccggcccggcgggctgggggccctggggaccgccgccggcgtgggcaccgcccccgccaccgcaaccggcctgggcgcccggggcgcaaatgatgtggaatccgaccggcgccggtaactggggaatctggaacaacggagtgtggaccccgctctgagcacccggacccggtgccggcggcgctcgacgcgtcgaacggtcggccgccgcagggttagggtgaattgtggccgcagaacactgggccgagcctcccgaggaatccgagcgtcggtccgacgcgctcgatcagcgcgagaaggccctggcccggcgggaggccgacgtcagacgacgtgaatggctggcgggtcgacgagaccgggtcgccgatcagcgcgagcagatcgccgacgagcgcgagcgcctggccgacgaacgcgagcagctcgccgacgaacgcgagggcacggtcgccgagcgggaacgggcgcgactgcgccgcatcgacgaacgggtcaagcgcacgcgggcgcgcgctaaccgggagcaagccgaggtcgaccgcgagatcgcggaaagcgagcgagacgacgcgtaaggccgggtcgccgaaggcgtaagcattttgctgcggcaaatatacccgtgtgtaatatattggctcagtctgcggcgcacgtcattgtccgtttagcgaatgacctgtgccacaaattttggatcgcaataaaccttattgctagcctccctggccatggtcgttattgcaacattgatgtcgttgatcaatcaggtctccggcacgccttatatttcgggtggagattctccggctgggaccgattgttcgggacttgcttcgtggattgcgaatgcagcaactgacaggccagtgttcggagaccggttcaataccggaaacgaggaagccgcgttgttggcccggggcttccaatacggcaccgcccccaacgccttggtgatcggctggaacggcggccacaccgcggtgacgctgccggacgggacggcggtgtccagcggcgagcacggcggcgtccacgtcgggggcgccggtgcctaccaggccggattcacccaccacatgttcctgccgatgccccccgaggacggcggcgcgccgcccccgccggacgcaccgccgcccccgccggacgcaccggctccgccgcccgacgcgccgcctgcgccgccggaagcgcccgccgttctgatcgatgcgccggcgcccgtgccgccgcccccgccgggcccctgaattaccttttcccggcgacgcagtaattgcgaatccataacgaataaaacgcggccgtacaagtgattgttacccggtttcggcgccccggttcgcgaccattctctgttccgcaaagtgaaatagcgcggatatccgcggccatgtgagctgggccactgcgtgcgcgggacgggtggcgcgcggcaaaagcgtgctgatgtgtcgcctgacggatgagaccactttgctgtgattatttcgcccaaaaaagcgacctgccatcgcggccggggccgggccgcggtggcgacccggccccgataggctggcgctgcccgcgggcatgggcgggcgtcatcccaagtcatcccaagtcatcccaagcgccatcccaagtcatcccagcagcgaaccgaggcggggccgcaatgatcttcatcgtcgtcaagttcgagaccaaacccgagtgggccgaccgctggccggacttcgtcgccgcgttcaccgctgccaccccgggccgaggagggcaacctgtggttcgagtggtcgcgcagcctggacgacccggccgagtacgtgctggtggaggcgttccgcgacggtgacgccggcagcgctcacgtcaacagcgaccacttcaagcgggcgatgcaagagctcccgcaggcgctgaagtccacgcccaagatcatcagccagaccgtcgaggccacggggtggtcgcggatgggcgagatgacggtcgactaacccctcaccgatcgaccgcgatctcgatctcgtcgcccagcgcatagcccggcgtgagcggaagcttgtcgccgctccagaacgagcccgggtcgaaccagttcgagtatttctcggtggtgagcagacccatttcctcgtaggtgatcgccacggtttccgcgcagtaggccgcttccagaccgagccgttgacgttcctttcgtcggcgcattgtctcccgaatcttcttgtccaccacggggattccgcgtgcccagtcgtaggcggtgggcagtcggccgcgcagccaccggccggtgaggcgcatggtggtgggaaacgcggtgccgtccatccgggcgatcacgcgcagcagcctgttctcctgctcgcgggtggccggcggcgtcagctggcgcagccagcaccgttggcggtagcgctgcgtccactgcaacaccgactggtgcagatcgttgagttgcacgccacgatgattcgtcccggtccacaggtcgacgagcttgtcacccagctcggcgtgccagatgagcggcggcaggtcatcgatggccaccgtcatgccgacgtgattgacggggctgttggtcaacgtctggatggcgcggtcgggacccgaaccgccgcgaaacagccacaggtcaccggtccgggtctcctcgagcgcttggttcaaggtgagcatcgtgtaagcccgtctcccgctgcaattttcgccgacatcgccgccgccccgccccgcttctcgcgggtaaggccaggcggggatccagtcaatcacaactacgcctagcctggtggcatgcgcagcatgtggaagtggctcgggctggccggtgcggccggcgtcgtcgccggcggcgtgctggtggtccgcgaccaacggaaacgccgggcctacaccgccgacgaggtccgggatcgtttgcatcagcggctggccgaatacgatgcgcttcagtcgggatcgggcgaggccagcacggcgaacaaccggtaggtgcccgagaatcccttgagctcgacctcgcgtccgtcatcgaaccggatcccgtcggagcgcgaaagcgcgtctcgcaccggctgactcaccaggatctccccaccggcggcctgggcggcgacccgcgccgccatcgcgacgttgcggccgaacaggtcgtcgccgcggcgcaccgagcggcccatgtggatcccgatccggacccgaatctcctcgtgccgcttgcggtttgcgttccggcgcaacgcgcgctgcaactcgatgccgcaccgcaccgcctgctcgggccgggcgaaggcgaccatgaatccgtcgccctggctcttcaccacgtgaccggattggcgccgcaccagatccgagaccagcttgtcgtgcgagctgatcagcttgacccaggcccggtcgccgatccgctcgttgagcgcggtggattcctcgatgtcggtgaacaggatcaccacccggccgtccggggtcacccgggccaggtcgggccgctccacctcggcccagtccgcgagctcctcgatcgagctgcgcaccgccgcgccgaaaccctccttgcgcacgagattggcggtgttccataccgtcttgaccgcttcccgcccgcccgcgagcagccagttgcgggcgtcggtgcgctgacgcagctcgtcgagttcggcgcggctgcgcaccagccgccgccacagcacggccagcgcgccggcctcgacggcggccagcccggccaggatgtagaccgtgacatgcagcacgtcacccatgccggtcatcctgtcaggcggcgccgcggtcgggctggcgcccctgccgggctgtgtctagtgttgagtccgccggccgcgggtagtgagtctcaagggagccgatcgggtgactttcgggaggagcggtcttggccgacgatgacagccatccatccgacctgctggtgatcttcggaatcaccggggacttggcgcgcaagatgacgttccgcgcgctctaccggctggagcgccgcgaggagctcgagcacccgatcatcggcgtggccagcgacgacatcaccctcgaccagctgctggaccgcgcccgggaggcgatcaaggccaccggtgagacgttcgacgacgcggtgttcgaccgcttggcgggccggctgtcctacctgtcgggcgacgtcaccgacgccgggctctacagcgagctcgccaagaagatcggtggcgattcgcgtccgctgtactacctggagatgccgccgtcgttgttcgcgccgatcgtggagaacctggccaaggccgacctactggaacgcgccagggtggcggtggaaaagccgttcggccacgacctggaatctgcgcgcgacctcaacgcccggctgcgcgcggtgctcgacgaagaccaaatcctgcgcgtagaccactttttgggcaaacagccggtcgaagaactgcaatacctgcggttcgccaacaacgccctggccaagctgtgggaccgcgacagcatctccgaaatccacatcaccatggccgaggacttcggcatcgaggaccgcggcaagttctatgacgccgtgggggcggtgcgcgacgtcgtgcaaaaccatctgctgcaggtgctcgcgctggtcgccatggaacccccggtgggggcgggcgccgacgacctcaacgacaagaaggccgaggtgttccgggccatgccgtcgctggacccggagcactgcgtgcgtggccagtatcgcggctacaccgaagtccccggtgtggcaaaggattccaccaccgagacctacgtcgcgctgagggccgagatcgacaactggcgctgggccggggtgccgatcttcctgcgcgccggcaaggcgttgccgcacaaggtcaccgaggtccggatgttcctgcatcacgtgcccggcttctccttcctgcccaaccgccgcccgcccgagcccaaccagatcgtgctgcgcatcgaccccgatcccgggatgcgcctgcagctgtccgctcaggtcggcgactcgtggcacgacgtgcacctggactcctcgttcgcggtggacctcggcgaaccggtgcggccctacgaacggctgctctacgccgcgttcaacggcgaccgccagctgtttgcccgcgaggacgccatcgaagagacctggcggatcgtgcagccggtgctggacaagccgagccgcatccaccaatacgagcaaggctcctggggacccgaggccgcgcaggcgctggtgcacggtcgccacgcctggcagcaaccgtggctgccgcagagcacgtccacgaaacgataaggaggctcgagacacgatgcagctggggatgatcggcctgggccggatgggtgccaacatcgtccgacgggtggtcaagggcggacacgaatgcgttgtctacgaccacaatccggacgcggtcaaggcgatggcgggggaggagaagacgaccggggtctcctcgctgcaagagctcgccgcgaagctgagcgccccgcgggtggtgtgggtgatggtgccggccgggacgatcaccaccggggtgatcgaggagctggccaccacgctggagcccggcgacatcgtcatcgacggcggcaactcctactaccgcgacgacattcgtcactcgaagaccctgtcggagaaggggattcggctgctggactgcggcaccagcggcggcgtctggggccgggaacggggttactgcctgatgatcggcggcgacgaggaggcgttcgcgcacgccgagccgatcttcgccaccgtcgcaccgggggtggacgccgcgccgcggacgccgggccgcgacggcgaggtcacccggtcggagcaggggtatctgcattgcgggccgtccggcgccgggcacttcgtgaagatggtgcacaacggcatcgagtacgggatgatggcctcgctcgccgagggactcaacgtgttgcgcaacgccgacatcggcaagcacgcgcaggaaggcgacgccgaaaccgcgccgctgtccaatcccgagttctaccaatacgatttcgacatccccgaggtcgccgaggtgtggcggcgcggcagcgtcatcggatcctggctgctggatctcacggcgatcgcactgcacgaatcaccggagctcaaggagttctccgggcgggtctccgactcgggggagggccgctggacgtccatcgccgcgatcgacgagggggtccccacgccggtgctgaccaccgcgctgcagtcccgcttcgcttcccggcatctcgatgacttcgccaacaagacgctctcggcgatgcgtaagcaattcggcgggcacgccgagaagccggccaactagccgcgcggatttctcagcggcgcttgacgaacgccaccacggcgtcgctgaacgcgtcgttgtcgtcgccggccgcggtgtgcccggcgttggacagctcgacgaactccgcgcgcggcacggtggccaaaaagtgccggaccccctcggggctcaccacatcggagagcttgccgcggatcagcaggaccgggatcgacaggttcttggcggcctgctcgaagctttcggtgcgcagttcgggatcgtcgccgggcttggtcatgaacgccgggtcccagtgccagtaccagcggccgtcgcgcagcctcagattcttcttcagcccctcggggctgcgcggcttgctgcggtagggcagataggcggcgacggcgtcggcggcctgctccagcgagtcgaagccgtccaggccgctgatcatgaagtcgcggatgcgggcgctgccgtccttctcgaaccggggcaccacgtccaccagcaccaggcgggtcaccttcgccggcccggcccggtgcgcggccaggatgccggtcagcccgcccatgctcgccccgatgatcgtcaccggccgcccgatcgcgtccagcacccgcagcacgtcggccgtcagcgtctcgatctggtagtcggcctgcggcgagcgatcgctgtcgccgtgcccccgggaatccagcgccaccacgtgcagcccctcgtcggccaacgtctgcccggtgttcttccaggaaaaccggttctggccgccgccgtgcagcatcaagatgctcggccggccggcgccgtcggagccccgattccattcgtcggcgaccagggtgatcccgtcgacgccggcaaactccaccgtctcgggactgctgctgacggtactcatgggttctgacgttacataggtggcataagcactcttgcgcgggccgacgacgcgatgagtttccacggccgccggggtctaccccagcacaaccaaccagccggcgaggaggcccgcggacatgccatcgatcaccccgtccttgtggttcgacgacaacctggaggaggcggccacgttctacacctcggtgttcccgaactcgcacatcgaggggttcaaccggaccaccgaggccggcccgggcgagcccgggacggtgctgtcgggcagcttcgtgctggacggctcgcggttcatcgggatcaacggcggcccgcacttccggttcagcgaggcggtgtcgttcacggtgcactgcaaggaccaggacgaggtcgactactactgggaccggttgagcgacggcggcgaggaatcccaatgcggctggctcaaagaccgcttcggcctgagctggcaaatcgtccccgaccggctcttcgaactgatcggcgaccccgatcgcagcagggcggcggcggccacccaggcgatgtacggcatgcgcaagatcgtcatcgccgagctggagcgggccgcggcatcctcatagcgaaacccgctgacgcagtggcggtttgacttcatacttactgcggtcggtgcgtctcgacgacacacgggttaggttggtccgtgcggacgcgccgagcagggagtgaagatggctgaaccaggctggatcgacgtgaccggccctgcgggggacctgaaggcgctcacctgggggccgcccgacggcccgctcgcgttgtgtctgcacggcttccccgacacgccgtacgggtggcgcaagctcgctgcccggctcgccgacgcggggtggcgggtggtcgcgcccttcatgcgcggatacgcgccgtcggcgatcccgtccgacggcagctaccacgtgggtgcgctgatggacgacgcgctgcgggtgcgcgcggccgccggcggtaccgacaacgacgtggtgatcggccacgactggggggcgatcgcggccaccggcctggccgccatgcccgacagcccgttcgccaaggcggtgctcatgtcggtgccgccctcggcggcgttccggcggcgcggcggcagcgcggccgagcggggccggctggccgcccatctggcccgccaggtgttccgcagctggtacatcctgtacttccaattgccttggctgcctgagcgttccgcttcctgggtgctgccgctgctgtggcggcgctggtcgccgggctaccgcgccgaggaggatctgcggcacgtcgacgccgcgatcggggcgccggagagctggagggcggcgctgggcccctaccgcgccaccatccgcaacaccgccccgccggcccagtacgcgacgttgcaccgactgtggaccgaggagccggtgctgccgtgtttgtaccttcatggccgcgacgacggttgcatgacatcggctttcgctcaccaggtggaaaaggtgctgccccccggcagcgaagtcgacatcgtcgaacatgccgggcacttcctgtagctcgaacagcccgacaaggtcgccggcctggtgctcgggttcatcggctcacccggctgaatgacgggccaccggatggcggccgtcgatgcgcagttctactggatgtcggccaagatccccaacgacgagttcctgctgtacgccttcgacggcgagccggccgattacccggctgccgccgaccagctgcgccggcgggccgacgcggagccggcgctgagcatccgggtgcgcgaccgcggccggctgcgctacccgcactgggtgcccgcggccgtcgcccccgagcaggtggtccgccacgagctggccgagcacagctgggacgggtgcctggccgctgtcgccgggctcgccgacgaccaactcgaccttcgccggatggcctggcggctgcacgttttcggcccggtccacggcattccgggggtccgcgggccgggcacggtcgcggtgctgcaggtcgcgcacgcgctggccgacggcgcccgcgccgcggcgttggccgcccggctgttcggccgggccgccccggtgcccgaggtgcccgtcccgcggccgggctggttgccctggcgggccgcggtggccgcgcgcacccactgccaactggtgcgtgacacccgtgccgggcggctggcccccggggccgggccgcgtccgctgctgccgacgaacgcccggcccgccggcgtgcgttcgctgcgcaccctggtgcggcaccgcgcgcagctgcccggtccgaccgccacggttgcggtgctgggtgcggtggcgcaggcgctgtccgatctgcttggcgatcaagcggattcgctgggcgccgaggttccgatggccaaacccggtgcgccgcaggcgtacaaccacttcggcaacgtcgtggtggacctgcatccgaggctgggggcccaggcccgcgcggagcggatcgcggcaggcctggccgccgggcggcgccgcttcgagcacccggcaacccgggccgccgaccgcgcattcgccgcggtgccggccgcgctgttgcgttggggcgtagaccaattcgacgccgaccagcgtccggaccaggtggccggcaacaccgtggtgtccagcgtcaatcgcgggccggccgatttgagcttcggcggcgcgcgggtggtgctgacggcgggctatcccgcgctgtcgccggtgatggggctgacgcacggcgtgcacggcatcggggacaccatcgcgatcagcgtgcacgcggcggcgtcggcggttcccgacgtcgacgcctacctggcgttgctcgacgcggcgctatgactattgcgcgtcaccggatctggcggcttcctgcctggtcaggccgacggcgacgatgagctcttcgtgcagttcgaaccacaccgtgtggtaggagtcgatcagcggcctggtcagccacgccgtgtcgccggcccgcaccttgtccagggccgcggccagtttcgccgcgtagcggttcagccgcggcagttgggcggccgcggcctcgatgaccggcgtgacccgcgcgtgcgcgtcgtccaggcgggccaacacggcgtcgtcgtactcggcgtcgtcgtggcggttgggcgcgccgtccttgagctgccagtcggtcaccaggcgcttgaaatcggcgttgatcgcccgaaagtcgtcatagacggcggccatcgcggcggcgtcgatgccccggcgttcctcggcgagcagcgccgtgagccgggcgctgccggccggggtgatccagagggtggcgtccccggtcaccaggcccgccgcgctcagccgctcgaccgtgccggcgatttcgtcgggatccgtgcccagggtggcggccaggtcggctcggctgacccggcccttgagccgaatcgcttgcagcacagccagttcggtcacggcgcgccctggcgcagcgcggtcagcatgaccagcagcggggtgggcgagaccacgtcggtctgcccggcggccagggccgcgcgcacggcgctctcggagtcgtcgtccagccgcggatggtcgccgccggaatgggcgcgcagcgggctgatcagccgcgcgatctcggccagctcccgcagctccggggtatcgttctcggaccatgcggacagggacaattcgccttcgcgcacttcgccttcggcgccgtcgacggtgatccgccggcccgccagcatcgcggccaccccggcgccgcaacccaccacggccacccggcccagttcccggctgaccaccgccgcatggctggccgcgccgcccacctcggtgacgatgccccgcgcggccagcatgcccgacacgtcttcgggccgggtgtggtcgcgcaccaggatcaccggttcgccccgctcggcggcgtgcagcgcctcgtcgacgtcggcgtaggccgtgccggataccacgccggggcaggcaggtaggcccttggccagaagtggtgccgccaaacgtatttcgggttgcagggcgggcatcagcagcgaccgcacgtgcgccggggtgacccgccgcagcgtctcggcgtcgtcgatcagcccctcgcgtcgcagctgcagcgccgagcgcaccgccgcctgcgccgagcgttcggccgcccgggtctgcagcaaccacagggcgccgtcctcgacggtgaactcgatctcctggacgtcacggtccaaccgctccagcgtccgggcggcggccatcagctggtcgtagacggccggctgctcgtcgcgcagcgcggcgatcggttccacgtcgaccgatcccgacaccacgtcgtcgccctggcccccgggcagccactcgccgaacggctcgtcgtccccggtgatcgggttgcgcgaaaagaacgctcccgcaccggaattggggccgtgattgccgaacaccatggcctgcacgacgacggcggtgccgtgccggtcggcgaaaccgtaatgggcgcggtaggcgcgggcgcgcggggagttccacgacgcgaacaccgcctcgatgccggcgcgcaactgcgtgtacgggtcggacggcaccggccgctcgacacccacgatgcgccggtacatctcgcggaaccgccggtgggtgtcgcgggcgaacgccggcccgtgctcggcggccagcgcctgctccacggagtcgttgatgccgaggttcaacagggtgtccatcatcccgggcatcgactgggtggcccccgagcgcacgctgaccagcagcgggtgcgggccccgcccgaacgtgcgcgaggtttgcgcctgcagccagccgatccggtccagcacgtcgtcccagacggcgtccatcgtcgccgcggggtcggccagataccgcaggcccaccgcggtggtgaggcagaacgcgggcggcaccggcaggtggtggcggcgcatcacctcgatgccgtggcccttgttgccaagcagctcgcgggggtggctcgatgtgccgtccagcaacaccacggactgctcggtcggcgcggcgtcccggtcgcgtgacgcgttgcggtgggcgccgctacctggtgcggtgcgagccgtggtgcacccccttcgtggtgtcgctgctgattcgggcaaccccggaacgcccgctatgttcccacacgggccggcgggtggactcagccgcgcggcggtcctgtcctccccggcggccgatgatctaggtttgcacctatgactccctacgacgtcgggttactgatcctgcggctggtgttgggcgtgacgttggccgcgcatggctacaacaagttcttcggcggtggccgcatcccgggcaccgcccggtggttcgagagcatcggcatgaagccgggcaagttccacgccaccgtggcggcaagcacggaaatggccgccggtctgggcctggccgccgggttgctcaccccgatcccggcggcgggcttcgtctcgctgatgctggtcgcggcgtggacggtgcaccgccccaacggcttcttcatcgtcaaggagggctgggaatacaacctggtgctggcggccagcgcggtggtggtggccaccctgggcgccggccggctcagcctggattggctggtcttcggcaagaactggatggacggctggaacggcctgctgatctcgctgctgcttggcctggccggggccatcggccagctggtgatcttctaccggccgcccgccaagcaaaccgggtagccccggcgcgcaccggtccagcgtcgacttgttgcgccgacacgccgggtgatcgcgcaactagtccacgctcgacgccgcggccggggcctcggccgcgcccgggtgtcgccgcgttgcccgaggttgccgggcgtgttcctagaacgcgttctagtctttgacaccatgggatttctgaagcccgagctaccgcagctcgacatggccgaatggagcaagggcacccgtagcgacaagatccgcccgatggccaagcactgggccgaggtgggcttcggcaccccggtcgccctgcacctgttctacgtcgtcaaaatcctgctctacatcctgggcgggtggctgttcgcctcggccacccggggtctcggcggcttcacccacgtcgcgtcgtggtggtcggagccgatcgtcttcgaaaaggtcgtgctctacacgatgctgttcgaggtgatcgggctgggctgcggcttcggcccgctgaacaaccgcttctttccgccgatgggctcgattctgtactggatgcgcttcggcaccatccggctgccaccgtggccggaccgggtcccgttcaccgcgggcaccaaacgcaagccggtcgacgtcgcgctgtacgcgctgtttctgctgctgacgctggccgcgctgttcgccgacggcaccgggcccgtgcccgagctgggcaccacgatcggcctgctgcccgcctggaagatcgtgctgatcctgctggtgctggcggtgctggggctgcgcgacaaggtgatcttcctggccgcccgcggcgaggtctacgccagcatggcggtgacgttcctgttcggggcgcccgacatgatcgtcgggtccaaggtggtcttcctggtgatctggatgggcgcggcgacatccaaactcaacaaacactttccgttcgtgatctccacgatgatgtccaacaacccgctggtgcgcccgcgctggctgaagcggaggttcttcgagaagttccccgacgatctgcggcccggccggctgtcacgctggatcgcgcatctgagcaccgcgatcgagatgctggtgccgttgccgctgttcttctgtcacggcggctggccggtcaccgtggccgcggtggtgatggtgtgcttccacctggggatcctggtctcgattccgatgggcgtgccgctggaatggaacgtgttcatgatcttcggggtgctgtcgctgttcgtggcgcacaccgggatcgggctcggcgaccttcggcaccccgtggtggtggccgtcctgttcgtcgtcatcgcgggaatcgtggtgttgggcaacatgtttccgcgcaagatctcgtttctgcccgggatgcgctactacgccggcaactgggacaccacgctgtggtgcatcaaaccgtcggccagcgagaagatcagccgcggcatcgtcgccatcgccagcatgccccaggcccagctggagcggttctacggcagcccggaggcggcgcagatcccgctctacatgggatatgcgttccgcggcttcaacactcacggccgggcgctgttcacgctggcgcaccgggcgatggcgggccagaacgaggacgactacgtcatcaccgacggcgagcggatctgcagcaccgcgatcggctggaacttcggcgacggccacatgcacaacgagcagctgatcgccgcgctgcaggagcgctgccacttcgagccgggcgaggtgcgggtggtgctgctcgacgcgcagcccattcacaagcagacgcaggcctaccggctggtcgacgcggccaccggtgagttcgagcgcggcatcgtgcgggtcgccgacatggtcgtgcggcaaccctgggacgacgacgtccccgtgcaggtggtgtcggacgacgcgccgagcgtcacgccagagtgacgccgaagcccgagcgtcacgctggcgtgacgctcgggcttcggcggctcagaccccggcccgaacctcgtgggccgcggcgaccatgttcttcagcgacgcgctcacctcgtcggggttgcgggtcttgagcccgcagtcggggttgacccacaaccgctcggccggcaccgcccgcagcgccgcgcgcaacgactcggcgatctcggcggtgctcggcacccgcggcgagtggatgtcgtagacccccggcccgacgctgttggagaagccgaccgcgttcaggtcgtcgagcacctccatgtgcgagcgggcggcctccagggaggtcacgtcggcgtccaggtcggcgatcgccccgatcacctcaccgaactccgagtagcacagatgggtgtggatctgggtcgagtcggcgaccccggaggtggccagccggaaagcgcctacggcccaacgcaaatactcgtcctgatcggcccggcgcagcggcaacagctcgcgcagcgccggctcgtcgacctggatgaccgcgatgcccgccgcctgcaggtccaccgtctcgtcgcggatggccagcgccacctggttggcggtgtcggccagcggctggtcgtcgcggacgaacgaccacgccaggatcgtcaccggcccggtcagcatgcccttcaccggcttgtcggtcagcgactgcgcgtagctgatccactcgaccgtcatcgggtgggtgcgcaccacatcgccgtacaggatcggcggccgcacgcagcggctgccgtaggactgcacccagccgttctgcgtcgcgaagaagccctccaactgctcggcgaagtactgcaccatgtcgttgcgctccggctcgccgtgcaccaacacgtcgaggccgagctgctcctgcagcgtgatgacgtcggcgatctcctttttcatccgcctctcgtactcggcctggtcgatctcgccggagcgtaatgccgcgcgcgccttgcggattgccgaggtctgcgggtaggagccgatggtcgtggtgggcagcggcggcaggtgcagccgcgcgtcctggctggcgcggcgctgggccgggtcgccgcggtgcgaaccagacgcgacgatcgagtcgatgcgggcccggacgcggtcgttgtgcaggcgggggtcgctcttgcgggaggcgacggccgcgttggacgccgcgatctcgtcggcgacggcctcgcgcccgtcgcgcagggcacgcgccagcgtcaccacctcggcgaccttctcccgcccgaacgccagccagctgcgcagcgcgtcgtccaggtcggtctccggctccagcgagtagggcacgtgcagcgtggagcacgacgtcgaaaccgcaacgcgcgctgccgaacccagcagcgtggtcagcttgtccagcgccgccgccaggtcggtgcgccacacgttgcggccgtcgaccacgccggccaccacggtcttgccggccagctcgggcacggcggcgacggcggtgtcggggccgtacaccaggtcgacgccgatcgcctcgacaggcgtgcgggccagcccggccagcgacgcccccgggtcaccgaagtaggtggcgacgtagatggccggccggttgcttgccgagcccagcttgttgtagaccgcctcggccagggcgggcgcgtcggcgcacatgtcggtcaccagcgccggctcgtcgagctgcacccactgcgccccgttgtcggcgagcagcgacagcagctcggcgtagatcggcaccagctcctcgagccgctcgatgggggcgcccgccccgtcgacgcccttgctgagcagcaggaaggtgatcggcccgatgaccacaggccgggccggaataccttgtgccagagcttctttcagctccgaaagcaccttgtcggggttcagcgcgaacttggtggtgggcgcgatctcggggacgatgtagtggtagttggtgtcgaaccacttggtcatctccagcggtgcgacgtcggagttgccgcgggcggccgcgaagtagcgatccaggtcgtcggacacctgccgggcccgctccggcagcgcgtcgagcatcaccgcggtgtcgagcatctggtcgtaataggagaaggtgttcaccggcaccgagtccaggccggcggccgccaggcccgcccaggtgtcgcggcgcagcgtcgcggccaccttttcgagctcggcgcgaccggtgcggccggcccagtagccctcggtggcgcgcttgagttcgcgcttcggcccgatgcgcggcgatccgacaaccgttgcggtgaatgcttgaggggtcacgatattcgtccttcaatcggcgtggtggtcaccgcccgcggacgtgcagccgacccgtcggcggtgggtacccggtaccgaccgcaacggctgcagccaaacgcccattccacgaggcgatgagccgccggacgcggcgcgcccggcacagctggcaggtctccggactcgcaggcgcgcaccgggtggtgcgtgcccggccgacgatgcggtcccgaagggccgccgaggagccgggcagttcctagtggccgtcgcttcccagtcttgcgaccagtgctggtgacggcggtcgttcctgcataccgttgcgggacagtcccggattctcaccgggttccctcttacgaagcgttactaacgttgcttcgctcgatgctcacggcgcggttgcgacgcgagcagaccagctgcgtagcgcagcttaccccgccgccgggcgggctcagccggccagtgcgacggcgatcggcacgtcaccgttgttgaagtcgatggtgcgccggatcgtcgagtcgtcggcgagggcggcggcggcgacgcttgcgacgtcggcgcgcgagacctcgcccttgccgcgcccgacggcgatgcggccggtgggcgggtccagggtgagccggcccggccccaggatcgtccagtccaggtcgctgacccgcaggtgggcgtcggccgcggccttggactccgcgtagggaaagaacggatcgtcttggggcacaccatgatcggggccggcgccgaagtaggacaccatcacgaaccgtttcactcccgaccgggcggcggcgtcgaccacccggatcgccgcgtcgcggtcgacggcatacgtgcgggccgggttgccgccgccggcccccgcggagaagaccacggcgtcgtgcccggccagcgcgtcggtgtccagccgctcgatgtcggccaccaccggcttggcgccggtggcggcgacgtcgtcggcgtgatcgggattgcggaacagcgaagtcaccgcgtcgccgcgctgcgtcaggatggcagacagctgcaacgcgaccttgccgtggccgccgacgatcacgactcgtgccatgacagccgacgctacgccggcccggtcagagcttcacgcggcccatgatgatgtcgatgatcggcttgcccggcgggtaggcgccggtcagcgacgccatggtgtggccgtagtcgaccagcagcgtgatcccgttgatgccgaaggcggcggcgctgttgaggaacgccatcacgtcgcccatctgttcgggcgtgtgcaccttggacccggtctcgtcgcggtagtcctgggcgaaggtgagccacaggtcggcgttggcctgggccagcggggtgtcggtgggaccggggcagatcgcgttgatccggatgcccttcttcagcagcggatagccctgggttgccacgtaggcgttgacgaccttcttggagaacccgtagtggatgatgccttccggctcgtgcgccttgacccattcctgcgccgtcgcgaagtccggggtggccaggaactcgttcagcaggtccaggtcgttctcccaccccatgcccgcgaccgaggagatgaagcagatcgccgagcccgacggcagctggttgcgttccagcagccgctcgatcaggtagcggtgtccgaggaagttgatcgccatcaggtcggtggtgccctcggcgatgccagcggccgagaacaccgcgtgcaccgggccgtcgagctgctcgagcgcggcgtcgatggacgcgggatcgcgcaggtcgacctggatggacttggcgacgtcgtaggtcaccggggcgtagtccagcacgatgacctcggcgcccagctcggccgcggatttggccgccgcggcgcccatgccggtcgcaccaccgaccaccagcgcgcgcttgccgtcgtagcgcagccgatcgacaatcgtcatggaaatccccttctcgttaatcgccaacccgattctaattgcccaactgtatggggaacggttatttggtttcaatacctagatatcgaccgggttgtcgacctagttgtcgacggcggcgccgcggaccgccacgccacgcaaaacggtgtcgcggacatgcagcagagctgggcgtttgccgatctcggcgaggatgttctccggtatccactgcagggcgatcaggcagcgcgccagcatcgcggtggacggcgcggcgatggcgatctcacccgtccggagcccttcggagagcagcgatttcatctgccgcaggcgggtggcgtaggaccagcccgggttggccgtcgggggagagagccgcatccaggcgagctggatccggaattcgtcggagaactggtccagcgcgttgacgttgacccagctcaacgcgtccagcttctcggtgggtgtggcgtcggagcgcagcacgctgacccatcccgcctccacctttttgccgaaggagcgcatgatcgagtccagcagctcgtccttggacccgatcacccgatacaccgttccggtgcccaggccggccgccgccgcgatgtccctgatggtggtgacttcataaccgcggcggccgaattcggcgcgtgccaccgcgcgcaccagcgccgctttgtcaccgggatcggcgtcgctgtcgtcggaccaggtttcgatcacctcgttggcggcggcgaaggccttcgaccggtccagcgcggtgtcgctgggcggccggcttgccaagccctgcaagatgattcggcacagcagttcggcgaccgggtcggcggatgcggtgtgccgcatgacgtcgagaccgacctgcagcatggtttggcagatgcggtcggccagcgtgggcaggtcgatgtcgggtttgatgtagccgctccaccggccggcgcgcagcgtctgcagcatcgcctcctggatggccaccggccgctgccgggtcagcttggtcagctccgggtcggtgcccggcccctcgtagaacgacatctgcaaagcggcgcggtgctcgacggcgcagttggcgatcgccgagccgagctcgatgatctgctcggggaccggacgtgagtcgggttcgtccaacctggcctgggcggcccggccgatcctctccagatcctcttggtagcggcgggtcagctcgacgaggatggcctctttggactcgaagtggtgatagaggctgccgggaaggatgccggcggcatcggcgatctcctgcaacgacgttcgcaggcccgaggacgcgatcagggacgcggcggtggccaggatctcggcccggcgcgtcggggaatcggcggtgctgccggctcggagcgactcggctttcgccatggtcagcggtgtgcagatccggacgactgcgggtgcgtgaccatacgcattcgtcctctttccgccgaaccaaatctttgttagaggctatcagaccggacccggtgaatgcgctgcacaagccgccgaaatcccatcctagagcggcggcgcgtcccaacggtcgcaggcgatcacttcctggatcggccgccgccgcgcgggccggaaggtgcgcccggcccgcagccggcccaccggcagcagacagccctggacgtaggtcggcggaatgccgagcagctgtgcgacttcgtcttcgtgatgcagatgcagcgtggtgatgcacgtcccgtatccccgggtgtgcagggccagctgaaagttccacaccggcgggaagatcgagccgtacagcgtggccaggtggaaggattcgtcgccgtcgatgcgcggcaagtaaggctcgtagcaagggattaccagcatgggcaccctggccaggttctcgaccagccactccgtcgacgacatgatgcggctctcgggtgttccggcgggcatcaggccggcgagcaaccgtccgccgacccgccgcagataggcgtcgcgatacagctcggcgatccgggcgcgcagcgccggatcgccgaccaccagccagcgccacgactgcgcgttcgacccgttcgcggcctgcaggccgatgcgcaggcactcgcggatgtcgccggggtcgaccggggcgtccaggtccagcgacttgcgcgccgacggcgtggcggtgagcaggtactcgacattcatcacggactgcctctcttggcaaggcgcgcaccgacttcggtgaggtagcggtcgggtccgccgagaaacgcgctgtagcccagcaaccgcttgagatagaggtgggcgtcgtgctcccaggtgtagccgatgccgccgaagacctggatagcggtgtcggccacgccggccagtcgcccggcgaacgccttcgcccgcagcgcggccagatgccgctcatcgccgtcgggcgcgtcgctaacccacagggcgtggatcaccccgctgcgggccaactcgacggtctcgtacatgtccacgcacagatgctggacggcctggaacgacccgatcggctgaccgaattgcgttcgggtcttggcatattcgacggcgaggtccatgacggcgcgggcggcgccgagcgcgtcggcgcaggcggcgatcagcacgtcgtcgaccaccgccgccacgtcgtccgccgacgccgtcgccagccgccgcgcgggggccgcgtcgaaggtgacccgcgactgtttgtgggtcgggtcgatgtggtgttcgggcgtgaccgcaaccccggccgatccggtgttcaccgcgaaaagcgctgtgtccccggcatcttcggccagagccagcaggacgtcggcggccgcggcatcgggcacggcgcgggcctgcccgtgcagcgccgtggtctcgccctctcgggtggcggccatgggcggggtgtccaggaagcagacggcgacgtgggtggtcccgtcggcgatgccgcgcagcagcccggcggcggtgtcgccgccggcgcacagccggatcagtgcccgcggggcggccaccgccgtcgacaaccacggacccggatacagcgcggcgccaagctcttcggccacgatcccggcctcgaccatcgtcatgcccgccccgccgtgttgttcgggcaccagcagcccggtgcagcccaggtcggccaggccgcgccataccgccggctcgatcccggtcgggtcgtcgagcagccggcgcacgtggtgtgcgatcggggccttctcggcgaggaagcgccgcgtggtgtcgcgcagcgccacctgttcgtcggtgagttcgaggttcatttgcgcggcaaccccaacacccgttgggcggtgatgttcttgttgatctgcgtggtgccgcccgcgatggtcagcgagcgcgacgtcagccggtagttcgcccacgcccgcccgtcgtcgcgggagcccagcacgtcgaaggccagcgcggccaggtcctgcccgatctcgccccacaccgttttggccaggctggccgaccccagcgccaccagttccgacccgccgtgcagggtggccgaaatcgaccgctggcacagcacttccagatatttgatccgcaccgcgagttcgccgaggcgccgcagcgtgaccgggtcgtccagcgcgccggtgccggcggcggccagatcgtccaccagctcttccagccgcacctgcatctctgcgtacaaccgggcggccccggcccgttcgtggctcagcgtggtggtggccacctgccagcccgcattgagcgggccgagcaacgcgtccgccggcacccgcacgtcgtgaaagaagacctcggcgaaatcggcgtcgccgcccagcgtgacccgtggacgggcctcgatgccgggcagcgtcatgtcgacgatcaggcacgagatccccttgtgcttgggcgcatccggatcggtgcgcacataaagctggcaccagtcggcgcggtggcccagcgaggtccagatcttctgcccggtgaccacgaagtcgtcaccgtcgcgcaccgcacgggtgcgcagcgccgcgaggtcggaccccgcatcgggttccgacatgccctggcaccagatgtcgtcggcgcgcatcatgcgcggcagcagccgctgcttctgcgcctcggtgccgtactgcatgatcgccggcgcgatgttgttcaagccaatgacgttgagcggcaagggagctcgcgcccgggtggtctcctcggtgtagaccagctgctcgagcaccgtcgcgccgcggccaccgtattcgcgcggccaggacaccgcggcccatcccgcgtcggccatcgtctggttccacgcccgcagcatctcgaacgcggcgtcgtcacggccgccggagcggcgtgctttcaccagctcgtcggtcaggttgtccgacagccagtcacgcagctcggtgcggaaccgttccacttccgcgggatagcagaaatccattttgccggacactacgtcggggcggattcgaggtcaatgacgcgacgccgcgagcggccgtcggtgacacggcgccacccgacggtgaactcaatcatcatgtgctcccgactcattgactgccgtgcagccggactctacggttggaacagatatttggtcaacaagtcggaggttgagcatgggggatgacgcctgtgccgaccagtggcaagccctgggcatgctcgcctccgcgctcgcgggccgggccgtcgcggtcgccgggctgccaccgggggagccggcgtggaccgacggccagacgatctacgtcgacgccggcgcgcccggggcgctcaaatccctagcggtgcaggcgtcgatgatcgccgccggcagcctgcgccccgacgtcgtgggccggttgctgcggcaccgcaagctggcccagcgctacctgaccgtcgaaggccaccgcgccctggtggccaacgcgccggtgctgccccgcgtgttggcgtccctgggcgaccgtggcgtcgccggccgcagcgattccccgcgggcgtcgctggcgctggccgccgcacgggtggcgctgcccgacccggcgccggaattcggggtgatccgggcggggaaggtgcttgccgcatgcgggcgggccgcccggccggaccagcccgacgacaaggcggcacccgcgcacgtcccgcggcgcgacggggccgccgacctcgcggagctcgacgacgcggcggtcgacgactcggacgacccggacctgttcaccagcccggtcggcgggggcggcgccctcggcaagtggctgaagaagctgctgtcgtcggcgcgcaagaccggcaccggcggcgggccgccgggcgcggacagccccacgcatcgcaccgattccggaaagcgcggtgcctacgccgtcgcctcgctggcgtcggcccccgccgacgaggggaacgacgaggatcccgccgacggggtgcggtatccggaatgggacgtggcgcgcgggagttaccggcccgcctggtgcaccgtgcgcgaggtcgagccggccatcacggcgcgggccacgctggccgtcgacgacgccatcgcggtgcgccgcccgctcgcgcgactgggcatgggtctgcaccggcggcaccggcagccgcagggcgacgacatcgacatcgacgccgcggtggaggcccgagtcgaggtacgggccgggtcggtgcccgacgaggcggtgtacctggacagcctgcggcgccgccgcgacctgtcggtgctgctgctcctcgacgtgtcggggtcggcggccgagccgggcaccgtcgggcgcaccgtgcatgagcagcagcgcgcggcggtcgccgatctcgctgtggcgcttcatgatttgggggatcgggtcgcgctgtacgcctactactcgcagggccggcgcgcggtgagcatggtgccggtgaagcggttccacgaccagctcaacgcccaggtgatcaggcggctcaacagcctcgagcccggtgcgtactcccggctgggcgcggccatccggcacggctcggcgatcttggaggcgcgcggcggcacgtcgcggcggctgttggtggtgctgtccgacgggctggcctacgaccacggatacgagcgggcctacggtgccgcggatgcgcgccgtgcgctgaccgaggcgcgccggcgggggaccggctgcgtgtgcctgaccgtcggcgcggggaccgacgtgcagtccctgcgccgggtgttcggcactaccgcgcacgcgacgatggcgcgccccgatcagctggccggggtgatcggtccgctgttccgctcggccctgcgcgcggcggaggtccgccgccgcaccgccgcgaacgcgcgtgccggtaccgcgacatcccgccggccgcacacatcggcgcacgtgggcgccggctaacagaagggaagccatggtcgaccagtccggacttgcatacgtccacgccgccgaggcgcgcccgtactaccgggcggtcggaagcgaggaggccgtcttcaaggccgcgtaccggcagggcctggcgctcgtcctcaagggcccgacgggctgcgggaagacccggttcgccgaagcgatggcctacgacctgggccggccgctgatcaccgtcgcctgccacgacgacctgaccaccgccgacctggtcggccgctacctgctgcgcggcgacgagacggtgtgggtggacggcccgctgacccgggcggtgcgggagggggcgatctgctacctcgacgaggtggtggaggcccgccaggacaccaccgtggtgctgcacccgctggccgaccaccgccggcagctgcccatcgagcgactcggcatcacgctggacgccgcgcccggcttcgggctggtggtgtcctacaaccccggctatcagagcgtgctgaaggatctcaaggattcgacgcgccagcgcatggtcgccatcgaattcgatttccctgcagccgatgtcgaggaggggatcgtcgcgcacgaggcgggcgtggacgccgccaccgcggccgagctggtccggttcgggcaggccatccgccggctggaaaccgccgggctgcgcgaggtcgcgtcgacgcgggtgctgatcgcggcgggcaggctggttgccgagggcctgagcctgcccgaggcggcccgggccgccatcgccgggccgttgaccgacgacgtggcggtgggcaaggccctgggcgagatgatcggcatctacttcgggtcgggcggttcgctcgggtccgatgattgacgctgcataccgcccccgctagggtctgaacaaatattaggtttacagaccggcgcgcgcgaatttgtccttgggaggtcagatgtcctacgaaagcagcgctgagccgatcaaggtcggctatctgatggacttcgccctgccgccggggttccccgaggagatgaaggccgacttcacccgctgtttcgacctcgtcttcgccgaggccgccgagcagggcgtgctggaccgaccggtccagatgatctaccgcgaggtggagggcctgcccaaaggatcggtcaaagcggtcatcgacgccttcggcgaactcgtcgacgagggctgcctggtggtgttcgggccgcacatcaccgacaactgcgtgcccacccgcgaggcgatcgaagagcggttcaaggtgccggcgctcagcgtcaccggcaccgacgactggctgggtgaatggaccttctccttcccgcaggggtcgatgaccgacgagccgatcttcatcgcggatctcgttgccaagcgcggactttccgagatcggagtgctcgtcgagcagaacctgatcggcgaaagctacctgaagaacctgcgcagcgcctgccggcgcaagggcattcgcatcgtcgccgaggcggccatcgcgcaaatcgcgcaggacatcaacgaggccgtgcgcacgctgcacgacgccaagtccgaggcgatcgtgcacctgggtttcgggttcggcatcgtgttcatcaatccggcactgcaggcggtcgattgggatccgccgcgcttcaccaccaccgccttccagaacgcctgggtcaacccgatcatgtggaacgccttcatgggctgggtcggcgtcgaccaatacgacgaggacaaccggatcgggcaggacttcctcgaccggtacgccgcaaagtacgggggccggcggccggaatattgcgtgccggtggtcaactgcgacgtcgccgccaccctggtgcgggccttcgccgatgcgcatccgctcagcccgcgcggggtcaaggaggcgctggagcgggtgaagatgatgccggcggcctccggtgcgcccggcacccgggtgtcgttcggcaagtggacgcgacgcgcctggatgggcgccgggtatctggtggccagaaccctcgacgccgacggcgtcaactcgcatctggtcgatcgtttcggagaggaaggttgacctgatgtcgaccgaacagaccacttcgcctgcggcacaacgggaatcggccgccccgcggcgaaccggcacacgcggctggggcggctgggtggccggcgccggcttggcggcgttcgcgctcttcttcatcgcgaactgccgcgtcgcgctggatccgcgggtggccgacccgaacgtgcagggccgtccgcgcccggtgaagttcatcttcggcctggattacatgacgttcatccagatctccaccgtggtcatgctgatcgtgttggtggtggtcttcgtcaggggatggcgccgcaacccgggcagcccggcgatgctgatgttcctgtgcaccaccctgatcgtgtggcaggacccgatcatgaactgggcgccgttcgcggtgtacaaccccgacctgatccactggccggaatcctggccgctggtgtcgttgtcgccgacggtggagccgttcgtcgtattcggttacgtgactttctatttcggaccgtacttcccggcggtgtggattctgcgcaggcttcaggccaagtacggcccgcagtcgttcttcgcgcggcacccgctggtcagcctgggcgtgctgacctgcgcgatcggtttcgtcttcgacgcctggctggagatccagctggtccacatgggcatgtacatctattcacaggtcatcccctggggttcggtgttcaccggcaccaccttccagttcccgctgatctgggagtcgttctcggtgaccttcgtgatggtcccggccgcgatcctgtgctatcgcgacgacaccggcaaatcggtggccgaaaagctggccgccaaagccaaactcttcccggcgcggccggtgctcggcaccttcctggtgatgttcgtcatcatcaacgtgtcctacttcgcctacggggcgtggttcgccgtcatcaaggccaccaaggcggcgacctccgtcgcctgcccctggccgtatccggaagccaaagtctatgacccacagggattttacgagaaggccggcgcgcagggcccatactcggtcggcatctggtcgacctggatgagcgggcaaccccacggccggcccgacgtgcagccgccaccacccggtgcgggcgcctgcgcgaccaccgcggtcgggcatggctgagccgcgcagcgtcgtcatcaccggcgcatcccgcggactggggttcgcctccgcgctgcggatgtatcgcgaagggtggcgggtggtcgccgccatgcgaacaccggatcagggaatgcccctgttgcgccgggccattcgcgacggcaccgggcaggaccccgacgacgaccggttgatcggcgtacagctcgatctgaccgacagcgcgtcggtcgccgcggccgccaaggccatcgaggaagccgtgggcgcaccgtctgcgatagtgcacaacgccgggatctcggccgccggaatggtggaggagaccgatacggcgttgtggcagcggatgttcgccaccagcgtgctgggcccggttgcgctcacccaggccctgttgccgtccatgcgggccgccgggcgggggcggatcgtcctggtgtccagcgcggccggggttcgcggccagcccggcaccgcgccgtactcggcggccaagggggcgctggaacggtggggcgaatcgctggcgggcgagatcgcgccgttcggtttgggggtgacggtgttggtggccggcacctatgacaccgagatcatcaccgacgccggcaccaccgacgaccgcaacttcagcggcccctatgcccgcctgcacaccaccatgaacacccgcgggcgcttggcggtcagtttcgcccggcggcccgagcggttcaccgacggcctgtacaaggcgctggacgaccgggcgccgttccgccgccgcggggtcggccccgacgcgtcggtgttgttggccgccaacaggatcctgccggcgtcgggcatgcaccacctgtcgcgggtggtgctgggcataccgcgtcagggatcgatgcgggacggggcgtggccgctgacgcacggccagcgggccatggtgttggtggcgcgggtgcttccgcagccggtgttgcagcgcctggccgcgctggccgggcggttctcgtcaccgaaaagcgcggcacgtcaaggggatcaagaggggtaatcatggagcaacttttcgacgacctggaagacttcggcgccttcgacgacgcggtctccggggacgtgcgcgacccgtacaccgaattggcccggctgcgccgcgaggagccgattcagcgattggacacctcgggcatgccgcacgaggaatccaagccggtgttcatcgtctaccgccacgaggacgcccagcagatgctgcgcgacaacgagacgttctcgtcggccgccgtcatcgcggcgttcgggccggtgctgggcgagcgcgtgatgctgggtatagacgagccggtgcacggacggctgcggtcgctggtgtcaaaggcgttctcgcagaaggcattggcgcgctgggaggacgagctggtcgggcgggtgggcaacagcctgatcgacaggttcgccggcaacggcaaggccgatctggtcaaggagttcaccttcgactatcccagccggatcatcgcgggcctgctgggcctgcccgagcaggactacccgcagtttcagcggtggtccatctcgttgctgagctggatcctgaatccggaacgcgggcttgccgcctcggccgcgctgtgcgactacttcgcgccgatcctggcggcgcggcgcgcagagcccaaggacgatctgatcagcgggctggcccaggccgagatcgacggcgagaagctggaagacgaggagatctactccttcctgcggctgctgctgccggccggggtggagacgacgtaccgggcgctgggcagcctgctgcttgcgctgctgtccgatccggagcagttggatgccatccgcggggaccgctcgctgctgccgcaggccatcgaggagggcgtgcgctgggagcccccgctgctgaccatcacccgggtggccacccgcgacaccgaactcggcggggtgccgatcccggccggctccacggtgatgccgatgctgggcgccgccaaccggcaggaggaccgctaccccgacccggacaggttcgacatcttccgcgcgcccaagagtcatctgggctgggggcacggcgtgcacgtctgcctgggcatgcatctggcccgcctggagatgcgcaccgccgtcaacctgctgctggaccggctgccgaaccttcggctggaccccgacgccgacgatccccacatccggggccaggtgttccggtcgccgacgtcggtcccggtgctgttcgacccgcaataaccagcccggcggcggccgcagcttgccaatcggctagtttccggtaaggctctccgtagcccctccgcgacccagaagagagtgacagatatgactgaggctgtaaaggtccgcttcgagccgaagatgatgatcgacggcaagctcgtcgacgggcaggccggaaccttcaccaacatcaaccccgccaccgaggagccgctcggcgaggtcgccgacgcctcgaaggaggacatgcaccgggccatcgacgccgcccggcgggccttcgacgagacggactggtcgaccaaccgggagctgcgcaagcgctgcctgctgcagctgcacgaggcgatcgagtcggagaaggaggagctgcgcgaggagctcatcctcgaggtgggttcgccgcgggccatcacgttcgggccccagctggacgccccgctggaagacgggctcaaatatcccgcgcgattgatcgacgagtacgcctgggagaccgacctgggcgacaaggtgatcagcctgaccggcacgctgaccacccgcaaggtctggcgtgagccggtgggcgtggtcggcgccatcgtgccgtggaacttcccgttcgaggtcaccctcaacaagctcggccaggcgctgggcaccggcaacaccgtggtgctcaagccggcgccgaacaccccgttcaacgccacccggctgggccggctgatcgccgagaagaccgacatcccggcgggcgtggtgaatgtcgtcaccgcctcggatcactttgtgggagaagagctcacgctctcgcccaaggtcgatctgatctcgttcaccgggtcgacggtggtcgggcagcggatcatggaaaagggcgcggcgaccatgaagcggctgttcctggagctgggcggcaagtcggccacgatcgtcctggaggacgccgatttcgggatggcctgcgcgatcgggatcgcgccgtgtatgcacgccggacagggctgcgccaaccccacccggatgctgctgccgcggtcccgctacgacgagggggtggcgatcctcaagggcatctacgagaacgtcacctgcggcgacccgcaggaccccgggccctttgcggcccggtcatttcgcaggtgcagcgcgaccgcgtgatgggctacatccgcaagggggtcgaagagggcgccaccgcactggtcggcggacccgacgcgcccaccggtttcgacaagggatactacgtacggccaacgcttttcaccgacgtcgacaactcgatgacgatcgcccaggaggagatcttcggaccggtgttgtgcgtcatcccgttcgacgacgaggaggacgccatccggatcgccaacgacagcaagtacggcctggccggcaacgtgatgtcgggctcgctggagcgctcgctttcggtggcgcgccggatccgggccggcttcatgggcgtcaacggcggcgcgccctacggcgccgacaccccgttcggtggctacaagtacagcggggtcgggcgccagaacggtgtggccggattcgaccagtacaccgagatcaagtcggtcgcctatccggccggctagcggtccgatgcctggtgccacgtaaagcgctgccacgcaacgccttcgacgatgcgcgccgggcttggggctgacggccgttggcggtcgggccgcgcctgctcaacgggccgggcccggacgtgctgcgcgggcgcatgtccggtcgccgctacgagcgaccgtcgccggatgacctaatctttgttcagtcgggtctacgtcgccccgccgccgcgcgtcgggcggttccgcccgatcgggtgagtggtccatgcgtccccggccgaatgcgccagcacatgcgctggcggattcgcgcggggtgtcatcgtcacccgctggtacgcatgtggccgatgtggccatgcccccggcgccgagcgaccccgccctccgacctgccaaccccttggttgacaatcgaggcaagactcactcttctcgaagtccacgtgtcaaaggagacaagaccatggctgaagccgtcatcgtcgaggcagtgcgctcaccgatcggcaagcgcaacggcgggttgtcgggggtgcatccggccgagctttccgcgcaggtgctcaacggcctggtcgacaaggccggcgtcgacccgggcatcgtcgacgacgtcatctggggctgcgtcatgcaggccggcgaacaggccctcgacatcggccgcaccgcgctgctgaccgccggctggcccgagaccgtgccgggcgtgaccgtcgaccggcagtgcgggtcgagccagcaatccatccacttcgcggcggcgggcgtgatcgccgggcactacgacgtcgtcgtcgccggcggcgtcgagtcgatgtcgcgcaccccgatgggcgcgtcgctggccaacggcgggcggccctacccccaggccttcctggaccgctaccagggccagatcccgaaccagggtatcggtgcggagatgatcgccgagaagtggggcttcgaccgcaccgcgctcgacgaattctccctggcgtcgcacgaaaaggccgcggccgcacaggattccggcgcattcgacgaccagatcgtgggcatcaaggaccaggacggcaatgtcgtcttgaaggacgagggcatccggcgcggcaccccgatggagaagatggcctcgctgaagccggcgttcaaggaggacggcgtgattcacgccggcaactcctcgcagatctccgacggttcggcggccatcctcttcatgtccgcggagaaggcaaaggagttggggctcaagccaatcgcgaaggtgcacaccgcgacgctggccggggccgacccggtgatcatgctgaccgcgcccatcccggcgacgcagaaggtgctcaagaagtccggcctgtccatcgacgacatcggcgtctacgaggtcaacgaggccttcgctccggtcccgatggcgtggctcaaggacatcggcgccgacgagaagaagctcaaccccaacggcggggcgatcgcgttgggccacccgctcggcggctcgggtgcccggatcatgaccacgctgctgtatcacatgcgggacaagggaattcgttacggcctgcagaccatgtgcgagggcggcgggcaggccaacgccaccatcgtggaactgttgtgaccgacgcgccgggggccctggccgaacgccggggcaacgtgatggtgataaccatcaaccggccggaagcccgcaacgcgatcaacgccgcggtcagcatcggcgtcggggatgcgctcgaagaggcgcaacacgaccccgaggtgcgggcggtggtgctcaccggcgcgggcgacaagtcgttctgcgccggggccgacctcaaggccatcgcgcggcgggagaacctgtatcaccccgaccatcccgaatggggcttcgccggctacgtgcgtcacttcatcgacaagcccaccatcgcggcggtcaacggcaccgccctgggcgggggcaccgagctggcgctggccagcgacctggtggtggccgacgagcgggcccagttcgggctgccggaggtcaagcgcggcctgatcgccgccgccggtggggtgttccggatcgccgagcagttaccccgcaaggtggcgatgcggctgctgctgaccggcgagccgctgtccgcggccgctgcccgcgactggggcctgatcaacgaggtggtcgaggccggctcggtgctggacgcggcgctggcgctggcctcggcgatcaccgtgaacgccccgctgtcggtgcaggccagcaagcggatcgcctacggcgtcgacgacggcgtggtggtcggcgacgaacccggctgggaccgcaccatgcgcgagatgcgggccctgctcaaatcggaggacgccaaggagggcccgcgggcgttcgccgagaagcgggagccggtctggcaggcgcgctgaacccacgccctagcgggccaggatgttcaccccggcgcggaacgcgccgggcaacagcgcgccggccggcacgatggcgcggcgcaccgcccgcggtgtgctggccagcaccagcgcgcgggtgagtagccgatagtcgcgggtgatccggtgccacgcggcttcatatgacgccggcctctcgtcgacgatggcccggaccgccgcggcggcctgcttgaccgccagactgatgccctcgccggtcagcgcatcctcatagccggccgcgtcgccgaccagcaggacgcgcccggcgacgcggcgggaaaccacctgccgcaacgggccgcagccgcgcggccggccacgctcggcggcgcgcaggcgcgcggccagccccgggaaccagcccaggtcgggacgtccgcgcgagagtatcgccacgccgaccaggtccggttcgaccggcgtcacatacgcctcaccccagcgcgaccagtgcacctcgacgaattccgaccacgccggcacccggtagtgccagcgcacgccgtagcgccgcggcgtcccggccgtcgccgcgatgccgacggcgcgccgcacggtcgagtgcagcccgtcggccgccaccaaccacctcgcgcgcacaccggcggccgacacgccgtgcgcatcctgcgcgacgctgctcacccgcgcccggatccattcggtgtcttgctctttggcgcgcgcggccagtgcggcgtgcaacgtggtgcgacgcactccgcggccgggcccgtcacgaaaccgggcctgggcccgccggtgctcgctcaggtaggcgatgccctggaacggcatgccggccgggtccacacccagcgcggtcagcgcggccagcccgcccggcatcaggccctcgccgcacgccttgtcgatgggcgcctcgcgcggctcggccacgatcaccgaaagcccaaggcggcgagcgtgtaacgccgtggccaacccgcccggaccgccgccgacgaccaacaggtccgcgtcgtaggccatcagcgccgctcctcctcgcatcgcttcgcatcgtcgccggcgcggtcgttcacgtgtagcccaaggccgaattctccacccgcagacgcactctcagcagcgcggcgttggccagcgtgaacaccgccgcggtgagccacgccgtgtgtaccaacggcaacgccaacccttcggccaccactgcaacatagttcggatggtgcaaccaacggtaggggccgtcgcgcaccagcggggcctgcggcagcacgatgacccgggtgttccaccgtcggcccagggtggtgatgcaccaccagcgcagcccctggctggccgccaccaccgccagcatcggccagcccagccagccgaggaacggccggtgcagcgcccacggttccaccaggcagccggccagcagcgcggtttggatgaacaccattaccgggtagtgggagcggccaaactccttgccgccctgggtaaacgaccagcgcgcgttccgggtggacaccagcagctcggcgacccgctccagcccgaccgccagcaccagcaggcaatacatggctacagtctttaccagtcctagaaggccagcagcaccagctcggagcagaacgccgggcccatcgcgatcatcaggccgatcgagccgggggccggcggatcggccaggttggccgcgagcacgtccagcaccgataccgaggacagattcccgttctcgcgcaacgagtttcgtgtgtggtcgagtgcgtcggcgggcaggtccaagacgctctcgacggcctcgatcacccggggcccgcccgggtggcacacccacgtcgtcacgtcgcgaggcgccaacccgtggtcggcgaggaagtcacggacgtcctcacccaggtacttctcggcgatgttggcgacgtcggcggacaacacgatccggaacccgtcgccgccgatcttccagcccatgacttcctcggtgtcgggatagatccggctgcgggtcgccaggatgcgcgggccggtgtgttcggcgccggcccgacgggcgccctcggtgatcaccgcggccgcaccgtcgccgaaaaggctggtggcgaccaggttggcgatcgaggtgtcgtgccgctggatggtcagcgagcacagttcgaccgccagcagcgcggccgtctggtcggggaatgcgcgcaggtagtcgtgcatgcgcgccactccggccgcaccggccacgcagcccaggccgaacagcgggacgcgcttgacatccggtcgcagccccacccgcgtggccagccgcgcctccaacgtcggtacggccagcccggtgaccgtcgtcgagaagacgatgtcgacctccgacggcttgaccttgccccggtccagcgccgccaccagcgcctgctcgccgaggtcgagcgcgacctcgaggtaggcgtcgttggcctcgctgaagccgctcagctcgcggtagcgcggcagccgcaacgcggtgttgcggaactcgactccgctgctgtgcgcgaaacgccgaaactccgggccggcaatgtcggtcagcgcccggatggcttcgctctgcgtgtagcggttgggcggaaacttgaccgcaacaccggtgatcgacggactttcccccacgatgtcccctgaaactgtgctcgtgccgacgaaatcgcggctccccctttgatccatgtaccggtgacgacggggccgcgccgatggttcaaacgcgcctcgcctcgccgcgcccgtaacgccacggcgggaattcgacccgaaaatcgccctgacgttacggacgcggtgggaaccccgcctacgcgcgcggtgggcaccccgcctacgcgcgcggtgggaactccgcctccgtacgcggtgggaactccggcccgccgccgggctgggctagggtcgggggttatgcgggttctggtcaccggcgccaccggctacgtgggatcgcggctggtcacggcgctgctggcgggtgggcacgacgtcttggccgcgacccgaaacccgttgcggctcaagcgtttcggctggttcgaagagatcaccccggtgcctctcgacgcggcggatccggcgtcgctgcggtcggcgttcgccggatgcggcccggtcgaggtggtgtattacctggtgcacgccatcggccagcccggtttccgggacgccgacaaggccgcggccgccaacctcgccgccgcggccaaggacgccggggtgcggcgcatcgtctatctgggcggcttcgtgcccgccggggaggtgctgtccgagcatctgaccagccgggccgaggtggccgaggcgctcgcggtgccggacggcccggagctggtgtggctgggcgcggcgatgatcatcggcgccggctcgacgtcgttcgagatgatgcggtatgtgggagatcgcttcccgctcatgccgataccgagctggatggacaaccccatcgaccccatctccatccgcgacgtgctgcactacctgctcgccgccgccgaccgtgacctggtgcccgccggcgcctacgacatctccggccccgacaccacgtcctaccggcggctgctcaagacctacgcgcggctgtccggccggtggcataccgggctgccggtgggtcgggtggacaccgggctggcgtcactggtcaccggcgtcgcgctgccggtgccgccggggctggccggcgacctggtcgagtcgctggaccacccgatggtggcctccggcagcgatctgcggcagcgggtccccgacccgcccggcgggctgctcggcgttgacgacgccatcgcccgggcgctggacgaccggtcgtaccggcggccccggccggtcaacgcgctggccgatccgcaccacctcgccgacaccgatcccgggtgggccggcggcgacgcgcggcgcatccgccagctcgccgggcgggtcacccccgccatcgcacggccgaccctggggctggtgaacaaggtccccggtccggtggccggagcggttcgcaccggcctcgacatcctgatcgctctgaccccgaaggtgcgtcccgcatgagccagtcaacgagcccgtaccacaccagcgtcttcgccgagctgcgccgcgccatcaccaatgttgctgtgccccacaatgaaccgccgaccatcgtccggcgccgacgcgtcgtcgtcgcgatcaccctggtgctcggggccgcggtgctgggctactcgttgcgccgccatccgggcgagtccagcttctactggctgacgctgggcctggcggcggtgtggaccgtcggggcgctgagctccggcccgctgcacctgggcggcatctgctggcggggccgcaaccaacgccccgtcatcaccgggacgacggtcgggctgttgctcggcggcgcgttcgtggtgggcgggctgatcgcccgggaaatcccggccgtgtccgcgttgatcacccgggtgctgctgttcgcccaccacgggtggttaccgctggtggtggcgatcacggtgatcaacggcatcgccgaggaactgttcttccgcggcgcgctgtacaccgcgctgggccggtatcacccggtgctgatctcgaccctgctgtacacggccgcgaccatggccgccggcaacccgatgctcggattcgccgcggtcatcctcggtacggtgtgtgcgctggaacgccgggccagcgggggcgtgctggccccggttctgacgcactgcgggtggggcctgatcatggtgctggccctgccgcccgtgttcgggctctgaccaatccgttgcgccgttgcggcgcaacgggattcagcgatcggtgaagttgggggtgcgccgctgctggaaggcggtggcgccctcgacgaagtcgggggacttcagcagcaccgactgtccgtcgaattcacgctgcagggccgggtccagctcggtgagcgtggccgcgttgatcgccagcttggtcttggcgaacgcgacggccggaccgctgagcaaccgtgcgatcaccttgtccacctcggcctcgaactcgtcggccgggtagacggcggtgaccagcccccaggccaacgcctcggcggccggcagccgttcgggcagcagcgccatctgcatggcccggatccggcccaccgcggcggccaccaacgccgacgcgccgccgtcgggcatcaacccgatcttggtgaaggcaagcatgaaaaacgcgttctccgaagccaatacgacgtcgcaggccaacgcgatggagacgccgacgccggccgccgggccctgcacgacggcgaccaccgggtggggcagcgcggcgatcgcccgcaccagccggttgatctcgaggatgatctcgtccggcgggacgccgccgccgtcggagacgtcgtcggcgctgatgcccgccccggagctgaagccgcggcccgccccgccgatccgcaccaccttgacctcggggtcggtggcggcgtactccatcgcgtcggcgatgccggtgatcaccggaacggtcagggaattcaggctgtcgggccggttgatggtcaccgagaacacgccgtcggacagcgtgacgtcgaggcctgcgacgggggcgagggtggcgatcgcggatgaaggcatgggctcaccataagtgaccggggtgcgcgggcttacggcacggctgcgaagatgtcgatcgaccggttgttagaggcgaacggtcgacggcgtcagagcggacgaaaggtcgatggatcatggctggaccgttgcagggactgcgtgttgtcgagttgtccggcatcgggccgggcccgcacgccgcgatgatcctgggggacctgggcgccgacgtggtgcgcatcgaccggccatccggcgcccccggcggtgtcgtcaaggacgccatgagccgcaatcgccgcatcgtcaccgccgacctgaaatccgaccaggggcgcgagctcgtgctcaaactggtcgccaaggccgacgtgctgatcgagggctaccgcccgggcgtcaccgagcggctcggcctgggcccgcaggactgcgccaaggtcaacgaccggctgatctacgcccggatgaccggctgggggcagaccggcccgcgcagccagcaggccggccacgacatcaactacatctcgctgaacggcatcctgcacgccatcggccgggcgaacgaacgccccgttccgccgctgaacctggtcggcgatttcggcggcggctcgatgttcctgctgctcggcatcctgtccgcactgtgggagcggcagagctccggcaagggccaggtcgtcgacgccgccatggtggacggctccagcgtgctggtccagatgatgtggcagatgcgggcctcggggatgtggaccgacgcgcgcggcaccaacctgctcgacggcggcgcgccctactacgacacctacgagtgcgccgacgggcgctacgtcgcggtcggcgccatcgagccgcagttctacgcggcgatgctggccgggctgggcctggacggtgccgacctgcccgggcagaacgacgtcagccgctggcccgagctgcgcgccgcgctgaccgagaagttcgccagccgcgaccgcgaccactgggccaaggtgttcgccgactccgacgcctgcgtgacgccggtgctggccttcggcgaggtgcagaccgagccgcacatcaccgagcgcaacaccttctacgaggtggacgggggactgcagccgctgccggcgccgcggttctcccgcaccgccccgcagacgccgcgccccgcggcgccggtgaccgacgcgacggccatactcgacgagtgggtatagtcccgaccaaccagttggctggctagggctcgggattcgaagggaattcaggaaggactcgcatggagatcaaggacgccgtcgccgttgtcaccgggggtgcctccggtctgggtctggccaccaccaaacgcctgctcgaccgcggcgcgcaggtggtggtcatcgacctgcgcggcgaagacgcggttcgcgagctgggggaccgggcgcggttcgtgcaggccgacgtcaccgacgaggccgccgtcggcaaggcgctggacaccgcggagtcgatgggaccgctgcgtatcaacgtcaactgcgccggcatcggcaacgccatcaagacgctgtccaaggacggcccgttcccgctggacgcgttcaagaaggtggtcggggtgaacctgatcggcaccttcaacgtgctgcggctggccgccgagcggatcgccaagaccgagccgatcgggcccggaacaagcccggagcgcggcgtcatcatcaacaccgcctcggtcgcggcgttcgaaggccagatcggccaggccgcctactcggcgtccaagggcggcgtggtgggcatgacgctgcccatcgcccgcgacctggcccgcgagctcatccgggtggtgaccatcgcgccggggctgttcaagaccccgctgctgggctcgctgcccgaggaggcgcaggcctcgctgggcaagcaggtgccgcacccggctcggctgggcgatcccgacgagtacggcgccctggccgtgcacatcgtcgagaacccgatgctcaacggcgaggtcatccgcttggacggcgccattcgcatggcgccccgctgagccacaccgctacgcaaacgaatgggcccccgcatccgcgggggcccattcgggagaacaatggttacttgcggaaccatcgactgacagcgggttcggccattaacagccgtgcgagcatgctcatggtcgggctcagctcgctgcttgcagttcgtcgaactgctccgaggtctcgccttccaccagcacgtcgccgtggtagagggcctcgaagtcaaccttgatgacgtcggcacttgtgtcgtcgatccacatgacactgagcgtatgggccaccattaaggaatccttgagtcacgattcggaaaacgttggcaatttacttccgggtaggttcgccgccgtcagcgccgcaaaatgcgccgtgagctgcttaattgccgcatatttttctgagcggactcttactgtcgaacaggtttgaaagccgccgttgaacggtgacaccgcccggttgcgtctctaaagagaacactgttggacgcgtgaaaattagcgtttgttaggttgtcgcggacaatccagcggccagcgcaatggggcgcaccggcagcggaagggctcacaatgctgcagaaaatcgcccgagtcgccatcgcggccccgcgtcggatcatcgcgctgggcgtgctggtcttcctggccgccgccgtcttcggcatcccggtcgccaagagcctgtcacctggcggcttccaggaccccgactccgagtcggcccgggccatcggggtgctgaccgacaagttcggccagagcggccagcagatgctgatcctggtcaccgcccccggcggcagcaacagcgacccggcccgcagggtgggcacggagctggtcgggcagttgcagcgctccccgctggtgtacaacgtgtcctcgccctggaccgcgccgccgcaggcctcggcggacctggtgagccgcgacggcaagtccgggctcatcgtcgtcaacctcaagggcggcgagaacttcgtgcagaacaacgcccaaaccctggccgaccaattcgtccacgaccgcgacggcgtcaccgtccgcgccggcggcgcggccatgcagtacgcccagatcaacacccagaaccaggccgacctgctggtgatggagatgatcgcgctgccgctgagcttcctggtgctgatctgggtgttcggcgggctgctggccgcggcactgccgatggcgctgggtgcgctggccgtcgtcggttccatgtcggtgctgcgcctgatcaccttcaccaccgaggtgtcgatcttcgcgctcaacctcagcaccgccctgggcctggcgctggccatcgactacaccctgctgatcgtcagccgctaccgcgacgagctggccgaggggcacgaccgggaccaggcgctgatccggaccatggccacctcgggccgcaccgtgctgttctccgcggtcaccgtggcgttgtcgatgtcggcgacggtggccttcccgatgtacttcctcaagtcgttcgcctacgccggcgtggccaccgtcgcgttcgtggcgaccgcctcgatcgtgatcaccccggccgcgatcgtgctgctcggcgaccggctggacgcgctggacgtgcgccggctgctgcggcgggcgttgcggcgggcccaaccggtgcgcaaacccgtcgagcagctgttctggtaccggtccagcaagttcgtgatgcgccggtgggcgcccgtcggcctgatcgtcgtcgggctgttgctgctgctcgggctgccgttcttctcggtcaagtgggggttcccggacgaccgggtgctgccccggtcggcgtcggcgcatcaggtcggcgaccggctgcgcagcggcttcgcccacgactcggcgacctcggtgcccgtcgtcatccccgacgccgccggcctgagcccggccgacctggacgactacgccgccgcgctgtcccgggtgcccgatgtgtcggcggtgtcggccctgggcggcaccttcaccggcggcacccgggtgggcccaccggccggggccaccgggctgggcgacggcagcgcgtttctgaccgtgagcagcaccgcgccgctgttctccacggcgaacgacgttcagctcaagcggttgcacgaggtgcccggaccggccggccggtcggtcgagatgggcggggtcgcgcaggtcaaccgggacagcgtcgacgcggtgacggaccggctgccgctggtgctgggattgatggcggcgatcaccttcgtgttgctgttcctgctcaccggcagcgtgctgctgccggccaaggcgctcgcgtgcaatttcctgtcgttgaccgcggcgttcggcgcgctggtgtggatcttccaggacggccacctcggcgcgctgggaaccacgccgagcgggacgctggtggccaacatgccggtgctgctgttctgcatcgcgttcgggttgtcgatggactacgaggtgttcctgctgtcccggatccgcgagtactggctggcctccggcgccgcccggccggcccggccgaccccgaagcgggcgcacgccgccaacgacgagagcgtggcgctgggcgtcgcccgcaccggccgggtgatcaccgcggccgcgctggtgatgtcgatgtcgttcgccgccctgatcgccgcccacgtctcgttcatgcggatgttcggcctgggcctgacgcttgccgtgttcgccgacgccaccctggtgcggatggtggtggtgccggcgtccatgcatgtgatgggccggtggaactggtgggcgcccaagccgctggcgtggctgcacgaccggttcggcatcagcgaggcggccgacgaagaaccccgcctcgccgagcctgccctcggacccgtcggatccgtcggactgcccggcggcgcggtcgccgaaccggtgcccaacatcggttgacggccgttcggccaaccgcccgtcgagtgtggcggtcggaccctattctgaggctcattcgaggcggaaggtgcacacaggcatgacaacggtggtcgtcgacaacccgttcttcgcgcgcatctggccggtcgtcgccacgcacgagacggcggcggtgcgggcccttcgccgggagaacgtggccggcctgaccggccgggtgctggaggtcggcgcgggcatcgggaccaactttccgctctacccggagacggtcgacgaggtgatcgcggtggagcccgagccgaggctggccgaccgggcccgcgccgcggcgcaggtggtgccggttcgggtcgtggtgaccggcgagacggccgaagcggtcggcggcgacgagccgttcgacgcggtggtgtgctcgctggtgttgtgttcggtgcgcgaccctcagggcgtgttgcggcgcctgtattcgttgctgcgcccgggcgggcagctgcgctacctcgagcacatcgccagtgcctgcgcgcggggtcgctttcagcgtttcgtcgatgcgacgttgtggccgcgactgttcggtaactgccacacccatcgcgacaccgaacgctcgatcgtcgaggcggggttcgacgtcgacgcgtcgcggcgggagtggacgttgccggcctggtcgccgatgccggtgtcggagctgttgctgggccgcgcgcaccggcccgcctagtccgcgctcagttgagcagcgccggcaaccgctgcagcagcccgggcaaggcctggctggccgtctcccggatgctgagcgtggcgctggccgacagcggcgtgacctcgggattgacctcgacgacggcggcgccgcgggacaacgccagctcggccagcccggccgccggatacacgatcgccgaggtgcccaccaccaccatcacgtcggcggactcggtcgcctcgacggcacgccgccacggctcgtcgggcagctgttcgccgaaccacacgatgtcgggcctgatcaggccgccgcatccgcacaccgggggttgcacctccagcgccggttcggccatcgccggcagctcgccggtgtagggctttgcgcaacgggcgcaacggaattcgaacaggctgccgtgcaggtggtgcacgggccggctaccggcccgctcgtgcaggtcgtcgacgttctgcgtgatgacgctgacctcggcgtggtcttgccaggcggcgatcgcgcgatgacccgcgttcggcgcgacgtcggccaccaggtagtgacgccacagataccagccccagacgcgctgcgggttgtcgcgccacccctgggtgctggacagctcgtaggggtcgaagcgggcccacagtccgttcttgtcgtcgcggaaggtcggcaccccgctctccgcggagatgcccgcgccgctgagcaccgctatgcgcatcccaccaagatagccgcggctgagcgatactgaacgagtggagctgggtgactggttgcgggtcgacatgaaggcgggcaagccgcttttcgaccagctcaggacgcaggtgatcgagggggtgcgcgagggcgcgctgccacccggcacccggctgcccaccgtgcgggagctggccggccagctcggcgtcgccgtcaacaccgtggcccgcggctaccgcgagctggaatcggccgccatcatcgaaacccggggccgcttcggcactttcgtcgcccgctacgaccccaccgacgccgcgatggcggccgcggcccgagagtacgtccgggtggcacgcggcctggggttggacaaggcggacgccgtgcgctacatcgaatcggtgcccgacgagtgagaagcccggccgggggctgaaaaaccttgccgccgtggggttttgcgacggctagctcaacaccttgaccagggtgcgcagattgcgggtggtggtcgacgacttgtaccgcggcttgcccatcgtcttgccgatggtgctgtccagggtgctgcccttgggcacctgccagtagagcacgcccagcggatcggggccgcggcggatcctctcgtcgggcccggccggcagggcggcgagttcgtccagcacggcggcgtcggccacgaacgtgacataggactggtagccgtcgacctcgcgctcgaacggatagccgtcgaccacccggcgcacggtgtcgaggtcatagaccaacacccaggcgtcgtagccgaaccgttcgcgcaacgcggcttcggccttcgcgcgcaccgccgccgcgccggccttcgactgcagcaggacgttgccgctggccaggaccgtccgcaccgcggtgaagccggcgtcggtcagggcctttttcacgtcggccatcttgagattgacgccgccgacgttgacgccccgcaaaaacgccgcgtattcggtcatgccccgattccaccagcccggcccggtgacgaccatcgggggccgccggtcggcgtgcgacgtaggctttcggcatgggacgccaagtcttcgacgacaaactgttggccgtcatcagtggaaattctctcggggtgctggccaccatcaaacgcgacgggcgaccgcagctgtcgaatgtgcagtaccacttcgacccgcgcagcctggtgatccaggtgtcgatcaccgagccgcgcgccaagacccgtaacctgcgccgggacccgcgggcatcgattctggtcgacgccgacgacggatggtcctatgccgtggccgagggcaccgcggaactcacaccgccggcggccgcacccgacgacgacaccgtgcaggggctgattgcgttgtaccgcaacatcgctggtgaacatccggactgggatgagtaccggcaggcgatggtcaccgatcggcgggtgttgctgacgctgccgatctcgcacgtctacggcatgccgcccgggatgcgctagccgcgccgtcacgctgtcccgccctgcccgccgggcggtccggggctaggctgccgctatggctgcatcgagtgcccgggagggttcacagtcgtcgaagtcttcgggcggcgccggatcgtcgaagtccgacgacgacaccaagcgcagattccgggaagccctggaccgcaagatggcgaaatccaccggcggctccgagcacaaggacggcgccggcaagcagtcgcgggcgcacggtccggtggagagccgccgggaattccgccgcaagagcggctgacacttctatagtcgatcatgttgtgcgccaacgtgtttcggcgctggtgatcgcccagtgcgagacggccggcgcggtggggattccggcgcggcgagcgtgcggtccgccgcgtgaacgccctggacgcggggcccggggcgcggttctagactgtctgcgtgccgaaactgcagcttgtccaagagccggccgccgacgccctgctggacgagaacccgttcgcgttactggtcggcatgctgctcgatcagcaggtgccgatcgagaccgccttcgccggccccaagaagatcgccgaccggatgggcgggctggacgccgcgacgatcgccgactacgacccggacaagttcgccgcactgtgttcggaaaggcctgccatacaccggtttccggggtcgatggccaagcgcatccaggccctggcgcagctgctggtggaccgctacggcggcgatgccgccgcgctgtggaccgccggtgagcccgacggcaaggagctgctgcgccggctcaagggactgcccggcttcggcgagcagaaggcgcggatcttcctggcgctgctgggcaagcagtacggggtgacgccgccgggctggcgggaagccgccggcgagttcggcaaagccggcacctacctgtctgtcgccgacatcgtcgacgcccggtcgctcgggcaggtgcggtcctacaagaagcagatgaaggcggcggccaaggcggccaagtagtgagtgcacggaagggaagggcgacaacgtgaagacacacataacgtgtccgtgcggcgaagccatcgtcggcaaggacgaggacgagctggtggaattgacccaggctcacctcgccagcgttcatcctggcctcgaatacgaccgcgacgccatcttgttcatggcctactgagcgcgaaggcgcgcgccccgggccgggacgcgcgcgttcgcgggcggtgcagcggtgacgccgttacggcaccaccgtggagccgatggtgggcatgaactggcactgccgttccttggtggtgacctgcccgaagatcgtcgacatgatgctgcccgagccggtgtcggcgatcgcgctcaacgtcgtgggcccgtccgggttgatgtccggccgcggtttcagcgcgacggttccggatttgccggtggtcaggttcacccaggtaacgttcaacggcagcttctgctcctcggcgggaccgggcgtgccgaccgccgtgaacacgtaggcggtctggccggggcccgggccgggggcggggatcttggccggccccgccaccgagagcgcggtggcgatggcgctgctgccgtcggccaggcagttggtgccgatcgagggatacatgaagtcctgcgtgggcggcgcgtcggcgccgaacccgggcgccgccgcgggggccggcgcggcgtcgggtgcgcccggggttgccggggccgcggcggccggcgccggtggcggcggaaccggtgcggcggccgggacggtggccggctgaaccggcccgggcgcgggagccgcggcgggtgccggagcggacggcggggtggcggcgggtgccgcgacgggtgccggagccgacggcgcagcggcggcgggtgccgggccggccgcgtgcgccgggtcgatgccggtcggcaggtgcgcctgcagacccggttcgatgccggtggccggcacgtgctggaccggcgcgccgtccggcggggtcacgccgttgggcaccggcgagccgggctcggcgacgaactggttcaccgccgcggccacgttcttcgactcggtgggcgcggtcgggttgtgactgaaggcttgcgcggcggccatcagcagctgggtggcttgctgcgggtcggtggccgcttgctggatcagcgggctgagctgcgacagggcgggcaggcccggcaattgcggggcggcgttgggtggtggtgccggctggggcgccgccgccgggtcggctgccgcgcccgggcacagcccgagcgcggcaaccgatgccgtgacgacagcggccaaacctttggacagaatccaagtggttgccacggtgtcctccggttctcagtagtgggttagccgattgacggtgctgctcaaggcagggcagcgagcagcggcgccaccggaccggccgggctggccgccggcgcgggtgccgcgggtgcggcgggggccgccggtgcgccgggggcctgccccgacgccagcgccggcagatccttgggcagcgtcacctgcgcgggcacgctgaccggcaggccggccggcatcgccggcatgttgacctgcgcctgcggcagctgcggggcgggcggcgtggcgggcgccgccggtgccgacaaccccgggatcgccggcaggccggggatcgacgaagaggccggagcggcgggagccgcggccgagggctgcgcgcccgtcaatccctggatcattccggggatgccaccggtcgccgtcgacggcgccgagggcgccgctgcctgcggcaggcccgggatggagggcacggccgccggggacgacgcggtcaccggcgagccggccgccggaacacccgggaagctgatgcccggggtggccggcggcgccggcggcgtggcgcccagcgcggtcgcgaggttctgcaggatttgcggtgcgttggccgccgagctgatcagctgctgcgggatgttgggcaccggcggagtgggcacggggtcggcgtgggcgattccgcccgtcagtagcgctgcggacgagccgaccacgacggcggctgcacgcaagtaagtccaaatggttggcatgactctccctggttgatcgattacaggtcccgccgccgaagctactttgatgcagatgggactcaagtgacacgtgtggcatttatttgatcgttaccgatacgagcgacagcggtgaccggacgcgcgaaaaccgcttgaaaacgggccatctgggcaccgaggccacggccgcgcgcgccccgatcgctaaagtcgggcggatagacaccacctcggccgccccggcggcacccagcacccggcgtgcggcggacgccctcgctgtggcggccccgctgctgctcgtcgcgagcgtcgccgcgcgcctggcctggacgtacctggtccccaacggcgcgaacttcgtcgacctgcacgtctacctcggcggagcggccgcgctcgaccaccccggcacgctgtacagctacgtctacgccgaccagacgccggacttcccgctgccgttcacctatccgccgttcgcggccatcgtcttctacccgctgcacctgctgccgttcggcctggtggccctgggttggcaactggcgaccatcgccgcgctgtacggcgccgtccggatcagccagcgcctgctgggcgtgccggccggcgcccacggccggcgcgtcgcgatggtgtggacggcggtcaccatctggatcgagccgctgcgcagcaccttcgactacggccaggtcaacgtgttgctgatgaccgcggtgctgtgggcggtctacagcacgcgatggtggctgtcgggtctgctggtcggattggcggccggcatcaagttaactcccgcggtcaccggtgtgtacctggccggtgcccggcggtgggccgcgacgatgttctcagccgtcatattccttgccaccattgggatttcggtcctcgtcgtcggcgaccagacgcgctactacttcaccgagctgctcggtgacgcccaccgggtcggccccatcgccacctcgttcaatcagtcctggcgcggcggcctctcccgaatcctgggtcacgacgtgggattcggcccgctgctggtgaccgccgtcgcgggcaccgcggtgctggccgtgctggcctggcgcgcactcgaccgctccgaccggctgggcaggttgatcgtggtggaggtgttcgggctgctgctctcgccgatctcctggacacaccactgggtgtggctggtgccgctgatgatctgggcgatccacggcccggtgcgcgcctggcgcggcgcgcgcctcgtggggtggggttggctggcgctgaccgtcatcggggtgccgtggttgttgagcttcgcgcaaccgaacatctggcagatcggccggccgtggtatctggcctgggcggggctggtctacatcgtcgcggcggtagcgacgttggtctggatcgcggccgccggccgccgcgccggtcaccaggtcaccgcgccgagcgtcacgccagcgtgaccgccgccggcgagcgtcacgccagcgtgaccgccgccggcgcaggcgagggcaggcgagggctagctgccgacgatgccgttgatgtcgcgcgccatgtcgacgtcgttttgggtgataccgccctcggaatgcgtgacgagcgcgaaagtcactgtccgccaacgaatgtcgatgtcggggtggtgatccttgctttccgcgtgctcggctacccggcgcacggcgtcgatgccgtccaggaagctgggaaacttgatcgaccgccgcagcgcgccgtcggcacgctcccatccgtccagatcgggcattgcggcgtcgatttgctcatccgttaacacagccatagctctgtcctcaaggcgcttttgcggtaggggtgcccggtccaccgtccaccacgccccagcttagtttcccgtcaccagatgtacaggacacgtcgcgaacgagcggtgaaccccagcggccggtcgactacgaggcgaccgcgggacccggcgcctgattcttcgggtccaagggcaccacgacgctggcttccgaagggctcgttcgttcctgataggcggattgcaggctggccggaagcccctggaggtcgcgggccacgtccattagttcctccaagatcatgatgcgttgctgattcgcttcctcgaccgtgcgccgtgcccgctcatcgagatcatcggccttctgcttcgcctcggcgaggagccgcgcgcactcacgctcagcttcctggcgcgcctcgtcgatcgccgcttgggcctccgcacgcatcgtcgcgagttcggcctcgagttccttcttggcgtcctcgcgctccgtttccaacgcctcccgctgtgcggccatgtccgccaacagctcttggtgctctcgatgcgatgcttcgacctgcgccgcggccgccgcgatcatcgactccgcctcggcctgcgcctcggcctgcatccgggaaatctcctcgagcgtgcggcgcagcatcttcgtcatccgatgctggatcgcgtacggcgtcggcgaggtgtccgagaggtgggcgacctcgtccttaaggcaggcgacttcgatccgcagcgcggccaattggtcgccggattcgtttcgctgcgccctgaggttctgaacttcgtcgatcagaagcttctgcttggccagcaacgcctcgacgtacgcatcgaccgcggcggggtcatagccccggaacacgcgtgagaacgccgttgcgggttcggtgatcatgtgccaacccccattctgcaaaagtgcctggcagaggccacaccggccaccgtcaagtattccacggtctccgcgaaaccgtaagagagttgttgtgcggcaagggaattgggtgcgctgcgcgggtaaggcgggcggcgtgcgcgccgacggtataccgtcactggccatgccgacccagatcgtggtcgccggggccctcatccgcggctcgcgcctgttggtggcccagcgcgcccgcccgccggagttggccgggcgctgggaactgcccggcggcaaggtcgcgcccggcgagaccgagcgcgacgcgctggcccgcgagttggccgaggagctggatctgcgggccggcgacatcgcggtgggcgaccggctcggcggggacatcgcggtcgacggtgggatgacgctgcgcgcctaccgggtgcggttgctgcgcggccgaccggacgcccgcgaccatcgggccctgcgctggatcaccgcggcgcagctgcacgacctcgactgggtgccggccgatcgcggctggctgggcgacctggcgcgggtcctttaaccaagtccacagacttccggcagctgacgcacagccgtgttgcaggtcgtcgcagtgaactgaatagaacaatatgacttgtaataacgacgccacacgaatctgccctggatgtgcgtgccgatagcgagccgagtgcttgttccgaccgtgccgtcccggcttcggtgccggaccggcaagcttcccgctgcccgcataccggcgcggctcacctggtgttttgccagccggtcgcgcgccctcgccgcggcggcggcggcctatgctgggcccgtatcgcccccagcccgcgggcctgaaatgccgacggatgagccgatccgggctggtgtggacgggtgggtccaccccgccggtcacaactgagagcgtgcccagctcgcggcgtgacgctatgaccaggaggagtacttcttgactgccacaccccacgtcggtggagtgctcgaggagctgctggagcgcagcgggcggttcttcacgccgggcgagttctccgccgacctgcgcacggtgacccggcagggcggccgcgaggccgacgtgttctaccgcgaccggtggagccatgacaaggtggttcgctccacgcacggggtgaactgcaccgggtcgtgctcgtggaagatctacgtcaaggacggcatcatcacctgggagacccagcagaccgactacccgtcggtgggtccggaccggcccgagtacgagccgcgcggctgcccccgcggcgcgtcgttttcctggtacagctactcgcccacccgggtgcgctacccatacgcccgcggcgtcctggtcgagatgtaccgggaagccaaggcacgcctcggcgatccggtgctggcctgggccgacatccaggccgaccccgagcgccgccgccgctaccagcgggcccgcggcaagggcggactggtccggatcacctgggccgaggccaccgagctgatcgccgccgcccacgtgcacaccatcaagacctacggccccgaccgggtggccggattctcgccgatcccggcgatgtcgatggtgtcctacaccgccggctcccggttcttcgagctgatcggcgccccgatgacctcgttctacgactggtatgccgacctcccggtggcctcgccccaggtgttcggcgaccagaccgacgtccccgaatccggggactggtgggacgcggcgtatttgatgatgtggggctccaacgtcccgatcacccgcacgcccgacgcgcactggatggccgaggcgcgctaccgcggcaccaaggtggtcaccgtcagcccggactacgccgacaacaccaagttcgccgacgagtggatgccctgcgccgccggcaccgacggggcgctggcgatggcgatgggtcacgtcatcctctcggaatgctatgtgcaaaaacaggttccgttcttcaccgactatgcccgccgctacaccgatctgccgttcttgatcaagctcgaagagcgcggcgacatggtgcctggcaagaacctcaccgcggccgacctcggcgaggcggtcgagaatgcggcactcaagcccgcgctgctcgacgagaccaccaattcggttgcggtgccgcacggttcgctgggcttccggtacggcgagtcgggcgtggggaagtggaacctggacctgggcgacctggtgccggcgctcagtgtgcgggccgccccgaccgaggacggggacacggcgctggtgcacctgcccagcttcgacaccgtcgacggcgaggggacgaccgtggcgcgcggcgtcccggtgcgccgcgtcggtaaacacctggtgtgcacggtcttcgacctgatgctcgcccaatacggggtggagcggccggggctgcccggcgaatggcccaccggctacgacgacgcgacccagcagaacaccccggcctggcaggaggcgatcaccggcgtgtcggccgcccaggccatccgggtggcgcgggaattcgcgcgcagcgcagaggaatccggtggccgctccatgatcatcatgggcggcggcatttgtcactggttccacagcgatgcgatctaccgcgcggtgctggcgctgctgatgctgaccgggtcgatgggccgcaacggcggcggctgggcgcactacgtcggccaggaaaaggtgcgcccgctcaccggatttcagaccatggcgatggcgacggactgggtgcgcccgccgcgccaggtgcccggtgcctcgtactggtacgcccacacggatcaatggcggtacgacggctacggggcggacaagctggccagcccggtgggccggggccggttcgccggcaggcacaccatcgacctgctggcctccgcggtggcgatggggtggagcccgtactacccgcagttcgaccggtccagcctggacgtcgccgacgaggcgcgcgccgccggccgcgatgtcgccgagtacgtcgccgagcagctcggccgccgcaacctcaaactcgcggtgaccgatccggacaacccggtcaactggccgcgggtgctgaccgtgtggcgcgccaacctgatcggttcgtcgggcaaggggggcgaatacttcctgcggcatctgctgggtaccgactccaacgcgtcggcggtgccgcccgaggacggggtgcggcccgtcgacgtgacctgcgagggagacatccccgagggcaagctcgacctgatgatgtcgatcgacttccggatgacctcgacgacgctggtgtccgacgtggtgctgccggcggcgacctggtacgagaaggccgacatctccagcaccgacatgcacccgtatgtgcacgcgttcagcgcggcgaccgacccgccctgggaaacccgttcggacttcgacgctttcggcgccatcgcccgcgcgttcagcaccatggccaaggagcacctgggcgcccgcaccgacgtggtgctcaccgcgctgcaacacgacacacccgacgcgatggcctatcccgatggcgccgaacacgattggctgcgcagcggggcgacgccggtgcccggacgcaccatgggcaagctcaccgtggtggggcgcgactacgccgccgtctacgacaagtggcgcacgctcggcccgctggtcgacaagttcgggttgaccacgaagggcgtcaccgtgcatccgttccgcgaggtcgaggaattggccgcccggttcggggtgctgaaatccggtgtggcggcgggccgcccggccatcacgaccgccgcgcggatggccgacgtgctgctgctgctgctgtcgggcaccaccaatggccggctggcggtcgagggtttccacgagctcgagaaacgcaccgggcagcggctggtgcatctggccgagggcagcgaggacaagcgcatcagctacgccgacacccaggcgcggccggttccggtggtcaccagcccggaatggtcgggcagcgagacgggtggccgccggtatgcgccgttcaccatcaacatcgagaacctcaagccgttccacacgctgaccggacggatgcacttctacctggcgcacgactgggtcgaggaactcggcgagcatctgccggtgttccgaccgccgctggacatggcgcggttgttcggccagccgcggctgggcgcatgcgaggacggagtcgggctcaccgtgcggtatctgaccccgcactcgaagtggtcgttccactccacctaccaggacaacctgtacatgctgtcgctgtcccgcggcggcccgaccatgtggatgagcccgggagatgcggcgaaaatccaagtgcgcgacaatgattgggtcgaggcggtcaacgccaacggcatctacgtgtgccgggccatcgtcagccaccggatgcccgacggggtggtgtacgtctatcacgtccaggagcgcaccgtggacaccccgcgcaccgaaaccaacgacaagcgcggaggcaaccacaacgcgctgacccgggtgcggatcaagcccagccacctggccggcgggtacgcccagcacgcgttcgcgttcaactacctggggccgaccggcaaccagcgcgacgaggtgacgatcgtccgtcgtcgcagccaagaggtggtgtactgacatgaaggtcatggcgcagctggcgatggtgatgaacctcgacaagtgcatcggctgccacacctgctcggtgacctgcaagcaggcctggaccaaccggtcgggcaccgaatacgtgtggttcaacaacgtcgaaacccgtccgggacaaggctatccgcgtacctacgaggaccaggagcggtggcgtggcggctggatccgcgacaagcggggccggctgcgattgcgtgacggcggccgtttccaaaagctgctgcgcatcttcgccaatcccaagctgccggtgatcggcgactactacgagccgtggacctacgactacgagaacctgaccaccgcacccgccggtgacaccttcccgactgccgcgccgaaaagcctgatcagcggcgagccgatgaaggtgtcctggggaccgaactgggacgacaacctggccgggtcgccggagatcctggccgaggacccgatcctgaagaaggtcagcgaagaggtgaaactctcgctcgagcagaccttcatgttctacctgccccggatctgcgagcactgcctcaacccgtcctgtgtggcctcgtgcccgtcgggcgcgatgtacaagcgcagcgaggacggcatcgtgctggtcgatcaggaccgctgccgcggctggcggatgtgtgtgtccggatgtccttacaagaaggtgtatttcaaccacaagacgggcaaggccgagaagtgcacgctgtgctatccgcggatggaggtggggctgcccaccatctgctcggagacctgcgtgggccggctgcgctatctgggtgtggtgctctacgacatggaccgggtactcgaggcggcgtcggtggaaaacgacaccgacctctaccgggcgcagtgcgatatcctgttggaccccaacgacaccgacgtcatcgccggcgcgcgggcgcagggcattcccgacgagtggatcgaggccgcgcagcgttccccggtgtacgcgctgatccacacctatcgggtggcgctgccgctgcacccggaataccggaccatgccgatggtgtggtacattccgccgctgtcgccggtggtcgacgcggtcagccgcgacggccacgacggcgaggacctgggcaacctgttcggcgcgctggacgcgctgcgcatcccgatgcaatacctggccgagctgttcaccgccggtgacaccgcggtggtcgagggcgtgttgcggcggctggcggcgatgcgctcctacatgcgcgacatcaacctcggccgcgaaacccagccgcacatcccgcattcggtgggcatgaccgaggaacagatctacgagatgtaccggttgctggccatcgcgaaatacgaagagcgctatgtcatcccgacggccttcgcgccgcaggcccgcgacctcgagcagatgggctgctcgttgaccggcgacggcgggccgggcatgtacgagtcggagccggtggccgtggagaccttccacgccctcaagcagcgcggcggccccaccgaggcagagcccggcagcacccggccgcgggtgaacctgctgaactgggacggcggccaggtgcccgccggcatgttccccgaggcgcagcggcgatgaggctgctgtcggcgctgcgggagcgctccagcagccgggtgatgcaggatcgcctggtgtggcaggcggcgtccctgctgctggcctaccccgacgacgggttcggcgggaggctggacaccgtggaagagttgctcggccatgtcagcggcccggccggcacgctgctcgggcagacagccgcggcactgcatggccgcgaaccgatggccgcggccatggactacgtcgcgaccttcgacatgcgccggcgcgccaccatgtacctgacctactggaccgccggagacacccgcaaccgcggccgcgagatgctggccttcgccaccgcctaccgcgaggcgggcgtgcagccgcccagcaacgaggcacccgaccacctgaccgtggtgctcgaattcgccgccaccgtcgaccccgacgccgggcggcggctgttgatcgcgcatcgggtgccgatcgacgtgctgcgctgcgccctggccgacgccaagtcgccgtacgagccggccgtcgcggccgtctgccagaccctgcccgcggcaaccgatcaggaggcgcgccgcgccgagcggctggcccgtcaactgttagaggccggcccgcccgcggaagccgttgggctgcaaccgtttaccttgaccgtgccacctcgagccgaaggaacccccggtgtttagcaacgtcctgttctgggacatctcgccctacgtcacgctgtcggtgctgatcgtgggcacctggtggcgctaccgctacgacaagttcggctggacgtcgcggtcgtcgcaaatctacgagtcgcggttgctgagcatcgccagcccgatcttccacttcggcatcctggccgtgttcgccggacacgtgatggggttgttcatcccgccgcgggtgacgcacatgctgaagatgagcgaccacctctaccacatgcaggccgtcatcgccgggtcggccgccggcttcgccaccctggccggcgtcgggctgctgatctaccgccgcttcacccgcccggcggtgtcggcggccaccacccgcagcgacaaggtgatgtacgtggtgctggtgctggccatcgtggtcggcctgtactgcgacctgatcggcaccggcccgcacggcggggagttccactaccgctacaccgtggggttgtggttccgccgcatctggatcctgcagccgcacggcgaggtgatggtcaacgcgccgctggactaccagttgcacgccctgatcggcatggtgctgttcacgctgtggccgttcactcggctggtgcacgtgttcagcgccccggtcgtctacctgttccggccctacatcgtctaccgcagccgcgaggtggcggccaaggaccaattggtgggcacggcgccgcgccgccgcggctggtaagacagcgcgccccggcgttcagtgtgcagccaggtaggcgacacgccgatggggcccgcccaggatgcacactgaaacgcccaggattcacactcgacgagcggacccgagcggcccgggttatccagccggttcgctatcggtggccccgcgctgccagaatctccgacgtgccatttcgcaacgtcgccatcgtcgcccacgtcgaccacggcaagaccaccctggtggacgcgatgctgcggcagtccggggcgctgcaccaccgcggcgacgacacccaggagcgcatcctggacagcggtgacctggagaaggaaaagggcatcaccatcctggccaagaacaccgccgtgcaccgccatcaccccgacggcagcgtcacggtcatcaacgtcatcgacacccccgggcacgccgacttcggcggcgaggtggagcgcgggctgtccatggtggacggggtgctgctgctggtcgacgcctcggaggggccgctgccgcagacccggttcgtgctgcgcaaggcgctggccgcgcacctgccggtgatcctggtggtcaacaagaccgaccggccggacgcccggatcgccgaggtggtggaggccagccacgacctgctgctcgacgtcgcctccgacctggacgacgaggccgccaaggccgccgagcacgcgctgggcctgccgacgctgtacgcctccggccgcgccggcgttgcgagcaccgagcaaccggccgacggcgaggtgcccgccggggagaacctcgacccgctgttcgacgtgctgctcgagcacatcccggcgccgtcgggcgacccggaggcgccgctgcaggcgctggtgaccaacctcgacgcgtcgaccttcctgggccggctcgccctgatccgcatctacaacggcaaactgcgcaagggccaacaggtggcctggatgcgcgaggtcgacgggctgccggtgatcaccagcgccaagatcaccgaactgctggccaccgagggcgtcgagcgcagccccaccgacgaggcgatcgccggcgacatcgtcgcggtggccgggctgcccgagatcatgatcggcgacaccctggccgaccccgaccacgcccacgcgctgccccggatcaccgtcgacgagccggcgatctcggtgaccatcggcaccaacacctcgccgctggccggcaaggtgcccggccacaagctgaccgcccggctggtccgcaaccggctggaccaggagctggtcggcaacgtgagcatccgggtcgtcgacatcggccggcccgacgcctgggaggtgcagggccgcggcgagctcgccctggccgtgctggtcgaacagatgcgccgggagggcttcgagctcaccgtcggcaagccgcaggtggtgacccgcaccatcgacggccagctgcacgagccgttcgaggcgatgacgatcgactgccccgaggagttcgtcggcgccatcacccagctgatggccgcccgcaagggccgcatggaggagatgaccaaccacgcggcgggctgggtccggatggacttcatcgtgcccagccgcgggctgatcggcttccgcaccgacttcctcaccatcacccgcggcaccggcatcgccaacgccgtgttcgacggctaccggccgtgggcgggggagatccgggcccgccacaccgggtcgctggtctccgaccgcgccggcaccatcacgccgttcgccatgatccagctcgccgaccgcggccagttcttcgtcgaacccggccaggacacctacgagggcatggtcgtcggaatcaacccgcgcgcagaggatctcgacatcaacgtcacccgggagaagaagctgaccaacatgcggtcctcgaccgccgatgtcagcgagacgctggccaagccgctcgagctggacctggagcaggcgatggaattctgcgcggccgacgaatgcgtcgaggtgactccggagatcgtgcgggtgcgcaaggtcgagctggacgccacctcgcgggcgcgcagccgggcccgcgccaaggcccggggctgaaccactggtggtcggacgggctgctgtgcggctgctcgataccctgatcagcgtgccgagacgagtgcgccgggtgttcatggtgctcggcggcctggtttcggtggtcggcctggtgctttcggcgtgcacggtcaacccgccgccggccccgcagagcaccgacacgccgcacaattcggtgccgccgccgccccgggtcagccagatcatcatgggcatcgactcgatcggggcgggcttcaacccgcacctgctctccgacctgtccccggtcaacgcggcgatcagcgcgctggtgctgcccagcgcgttccggccggtgcccgatcccaacacgcccaccggctcgcgctgggagatggacccgaccctgttggtgtccgcggaggtgacgagccagaacccgttcacggtgacctacaagatccggcccgaggcgcagtggaccgacaacgccccgatcgccgccgacgacttctggtacctgtggcaccagatggtcagccagcccggggtcgtcgacccggccggctacgacctgatcaccggcgtgcagtcgctggaaggcggcaagcaggcggtggtcaccttctccgagccctacccggcgtggaaagagttgttcaacaacatccttccggcgcacatcgtcaaggacgtgcccgggggtttcgccgccggtctggcccgggcgcttccggtcaccggcgggcagttccgggtggagagcatcgacccgcagcgcgacgagatcctgatcgcccgcaacgaccgctattgggggcccccggccaagcccgggctcatcctgttccggcgcgcgggagcgcctgcggcccttgccgattcggtgcgcaacggcgacacccaggtggcgcaggtgcacggcggctcggcggcgttcgcgcagctgtccgccatccccgacgtgcggaccgcccggatcgtcacaccgcgggtcatgcagctcacgctgcgcgccacccagcccaaacttgccgacacgcaagtgcgtaaggcgatcctgggattgctcgacgtcgacctgctcgcggcggtgggcgcgggcagcgacaacaccgtcaccctggaccaggcccagatccgggcgcccagcgaccccggctacgagccgaccgccccgccggcgatgacgacaccggcggcgctggcgttgctggaaggcgccggatacaaggtggagcccaacacctcggcctcaccggcgacgcccgccccgggtccacccaacaccgggccgcccgaggtcatccggggccggatcagcaaggacggccaacagctctcgctggccatcggggtggcggccaacgacccgaccgcggtggcggtggccaacaccgccgccgaccagctgcgcaacgtcggcatcgccgccaccgtgctggcgctggacccggtcaccctctaccgcgacgcgctgaacgacaaccgggtggacgcgatcgtcggatggcatcaggcgggcggcaacctggccacccggctggccgcccgctacggctgtcccgcgctgcagtccacccaggtgccggcctccaccgagccgacgcccacgtcgcccgccccgggcgggcccgccccgtcgaccggaccggccaccaggtcggcaacccccacctcgacagcaccgccgagccggcccgccgaccccaatgccctggtgcaggcgccgtccaacctcaccggcatctgcgatcgcagcatccagtccaacatcgacgccgccctcaacggcaccaagaacatcaacgacgtgatcaccgcggtcgaaccgcgactgtggaacatgtccacggtgctgccgatcctgcaggacaccaccatcgtggcggccggcccgagcgtgcagaacgtcagcctgtccggcgcggtcccggtcggcatcgtcggtgacgccggccaatggaccaagaccgggccgtagctagtcggcggcgcggtccgaatcccgcggcgggatcacggtatcgacgatcagggccagctcccgccggttcggcggcgacccgttcagcaggaaatgctggttgatcaacgccgacccgatgcgagcggtgagcggggtgatcgacttcggatcgaggtcgccgtcctgcacggcggactgcaggatcgattccacgatcttcagccgcggccggaccaccgcgtcggcgaagatggcccgcatctcgggctcgtgcaagagctgctggatgacctcgatgccgggaaacgcggtcttgccggccagcaggtcgcgctgcgcggtgaacatcgccagcaggttctcccgggccgaccggccggaccgcagctcgggcaccggcggcagcgcgaaaaccaatgcggcgtgcaccagttcgcacttggtgtcccagcgccggtagagcgcggccttgccggtgtgggcccgtgccgcgatgccctccatggtcaggcctccgtaaccgacttccgtcagctcggccagggtggcctcgtagagggcgcgttcgaggacctcgccgcgccgacggcttcggctgccggtccggtcggtcagctggggcatttcttgatagtagccgtgcgcgttcctatctgctgcttcccggcgcagcaaccgcaccacggcggccggtagggtgcgcttcatggctgagacgccgcggctgctgttcgtccacgcgcatcccgacgacgagagcctgggcaccggcgccaccatcgcgcactacaccgcggccggcgcggacgtccgggtggtgacctgcacgctgggcgaagagggcgaggtgatcggcgagcggtgggccgaactcgccgtcgatcgcgccgaccagctcggcggctaccggatcggcgaactgaccgccgcgctgcgggagctgggcgtcggcgaaccgtgctatctgggcggcgcgggccgctggcgcgattccggcatgcccggcacccccaggcggcgccggcagcgattcatcgacgccgacgagcgcgaggccgtcggcgcgctggtggccatcattcgcgagcagcgcccgcacgtcgtcgtcggctacgaccccgccggcgggtacggccaccccgaccacgtccacgtgcacaccgtgacgacggccgccgtggccgcggccggcgccggcaacttcccgggcgagccgtgggcggtacccaagttctactggtcggtgttcgcgacccggccgttcgaggcggccgtgcaggcgctgacgcccgaggacctgcggccgggctggtcgatgccctcggcggagcagttcaccttcggctacgccgacgagcacatcgacgccgtcgtcgcggcgggcccgcacgcctgggcggccaagcgggcggcgctggccgcgcacgccacccaggtggtcgtcgggccgaccggccgcgcctgcgcgctgtccaacaacgtggccctgcccatcctggacgaggagcactacgtcctggtcgccggcgccgccggcgcgcgcgacgagcgcggctgggagacggatctgctcgcgggcctggaattcggcgccgcccccaggcggtaggctgccaatcaggcagccacggaaggaattcgcatggaccccgacctggaccctaatcagcagcactggcaggaccggctcgacagcctgcagtgggttatcggctcgatactctccaacatcgacagcgttccgacctgaccgaaaccaagccgcgcgtcgcgtccggtgaagacagcggcgcgacagaccccgcgattcgtttcgttgtcctggcgctgttggcggtcgacggggttctctccgcactggccggggccctgctgctgcctttgtatatcgggacggttccctttcccatcagcggattgatttccgggctgctcaacgcggcgctggtgtgggccgccgggcgctggacccgatcaccgcggctggtcgcgctgccgctgtggacctggctgctgaccgtcgcggtgatcagcatgggcggcccggccgacgacgtcatcctgggcggccgcggggtgatggcctacggcgccctgctgctgctggtgctcggggtggcgccgccggtctgggtgctgtggcggcgcggccgcggcggctgagccgccgtgttccgggccgggatgtcgcccgcttgccggtgtgggcgtggcgctactgttgacagttgcccatccgggacccgccacgggtgccacgatttcacatgttgggacgcgcggatgaaattcgatcgtggggaagttacaccaaggtgctgttgactccgggcgaggagcctaccgccctacctgatcctgtggttccggccagggcctcatcgcgggccacgccgaaggcgaccgcctcggcgttacgacgggtgttgcggcgggctcgagatggcgttgcgctgaacatcgacgaggcggcggtcgcgatgaccgcgcgcggggacgacctggcggacctgtgcgccagcgcggcccgggtccgcgacgcgggcctgcagtcggccggccggcgcggcccgggcggcgggctgccgatcacctactcgcgcaaggttttcatcccggtcacccacctgtgccgggacaactgccactactgcaccttcgtcaccgtgccgggcaaactgcgcgcccgaggcgcgggcctgtacctcgagccggacgagattctcgacatcgcccgccgcggcggtgaactcggttgcaaggaagcgctattcaccctcggcgatcgccccgaggatcgctggcccgaggcgcgggagtggctggaggcgcgcggctacgattcgacgctgtcctacgtgcgggcgatggcgatccgggtgctcgaagagaccgggctgttgccgcacctgaaccccggcgtgatgagctggtcggagatggcgcggctcaagccggtggcgccgtccatgggcatgatgctcgagacgacgtcgcggcggctgttcgagacgaaaggccttgcgcactacggcagcccggacaaggacccggcggtgcgcctgcgcacgctgaccgacgcgggccggttgtcgattccgttcaccaccggtctgctggtcggcatcggcgagacacccgccgaacgcgccgacaccttgcacgcgattcgcaagtcgcacaaggagttcggccatgtgcaagaagtgatcgtgcagaacttccgggccaaggaacacaccgccatggccgcggtccccgacgccggcatcgaggattacctggcgaccgtggcggtggcgcggctggtgctgggccccgggatgcggattcaggccccgccgaacctggtgtcccgcgacgaatgccgggcgctgatcgccgccggggtcgacgactggggtggtgtgtcaccgctgacgcccgaccatgtcaaccccgagcggccgtggccggcgttggacgaattggccgccgtcactgccgaatccggctacgagctggtccagcggctgaccgcgcagcccaaatacgtgcaggcgggtgcggcctggatcgacccgcgggtgtccgggcatgtccgggcgctggccgatccggtgaccggtctggcccgcgacgtcaatccggtggggctgccgtggcaggaacccgacgacgtcggttcctcgggccgcgtcgacctcaacgcggcgatcgacacgcagggccgcaacagcgagacctgcagcgacatcgacagcgccttcggcgactgggagtcgatccgcgcgcacgtgcacgagctggccgcgcagggcgccagagcgccggaacgcctggacagcgacgtgctcgccgcgctgcgctccgccgaacgcgacccggccggctgcaccgacagcgaatacctgtcgctggccaccgccgacggtccggcgctggaagccgttgctgcccttgcggattcgttgcgccgcgacaccgtcggcgacgacgtgacgttcgtggtgaaccgcaacatcaacttcaccaacatctgctacaccggttgccggttctgcgccttcgcgcagcgcaagggcgacgccgacgcgtactcgctgtctaccgaggaggtcgccgaccgcgcctgggaggcgcacgtcgccggcgccaccgaggtgtgcatgcagggcggcatcgaccccgaactgccggtcaccggctacgccgatctggtccgcgcggtcaaggcgcgggtgccgtcgatgcacgtgcacgcgttctcgccgatggagatcgccaacggggtgaccaagagcgggctgtcgatcagggagtggctgatcagcctgcgcgaggccgggctggacaccatccccggcaccgcggccgagatcctcgacgacgaggtgcgctgggtgctgaccaagggcaagctgccgacctcgctgtggatcgagatcgtcaccaccgcacacgaagtggggctgcggtcgagctcgaccatgatgtacggccacgtcgacaacccccggcactgggtgggccacctcaacgtgctgcgcgacatccaggaccgcaccggcggtttcaccgagttcgtgccgctgcccttcgtgcatcagagctcgccgctgtatctggccggcgccgcccgtcccggccccacccatcgggacaaccgggcggtgcacgcgctggcccggatcatgttgcacggccgcatctcccagatccagaccagctgggtcaagctcggagtgcagcgcacccaggtgatgctcaacggcggcgccaacgacctgggcggcacgctgatggaggagaccatctcccggatggccggctccgaacacgggtcggctaagaccgtggccgagctgaccgcgatcgccgagggcatcgggcgcccggcgcgccagcgcaccaccgactacaccccgctggccgcctagttcgctttcctgtcacagccggcgggtatacccgagaccgtgaagcgacgaattgacgacgatcgatttccggagtggcgtccgttctgcgacgcggcgcaacggcgcggtcccgacgcgggcacctggtgtgaggcgtggacggtgcgcgacgtcgtcgtccaccaggccggaaacgccgaggagctggcccgggtgctcggcgctcacctggcgggcgagccggtggccacccgcggtttcgaggagcgggaaggcccgctgcgcgccctgaacgacgccgacctgtgggacgcgctggccgaccggatggccaccctcaacgaggtcgcggaggccgccgaagccatccccgccgacaccgacgtggcctggaccggccgcaccatgaaggtgccgtggttcgccgagcacatgcgcgaagaactcgtcctgcacggctgggacatcaccggggactccgacagcggcggggccttccaggcggggctggccgagccgtggatgaccacgcacagcgtgctcgcggtcggccggccgctgctggtgaagggggccaggcaactgcaacccggcgagcgggtcgaagcccggctgcgcgtcgacggcaccgacgacgtggtgctggacgccgatccggagcggatcagcatcgggttcgccgagccgcagggcccggccaccctggaaaccgacgcggccgcgcgggtgctgctgctgtgggggcgcaggcccgccgacccgtcacgcatccgcagccgcgtcggaccgcaggtcctgggacgggtgcgctgcctgctcggcggctactgaacggcttccggcgacccggcgcgctcagaagttgttacaggtgaccgcgacctggttgatgtcgttgatgtactgctgcgcggccggcatgccctggatctgctgggccatctgctgacgcttcgccggcggggaggccaggaaccgctggatgtaggactgcgccatcggcgacgagttcagctgctgggcagccgccgggtcggacgcgttcagcgcggcgatcacctgcccgtagttgcaggtggtgttgatgatcgcgtccatggggtcggcggatgcgacaccggccgcggcggtcaatgccactgccgcgctgcccaccgcaacgcccaatttgctcaacgacagcctcatgtgtggacaccttccccagtcaatgcaccgctattccggcgagaacatctgcccagcggttgccgtctttcggttgagattaccaggccccgcgagcgtgcttgcaccgcaacagatatcgaagaccgccgggtcgacgtaactctgcgcaggtcagcggcgtgtcgacggtgttcgcgctgggcgaaacggggcccgcgcgcgggctgcgagactgtcagtcttaaatcggtaacccgaggggcgcgccaaatggttgacctgtatctgcaacgtctagtatcagtaaccgaaagctccgccggaagcggtcgcgacgcgccggtgaaagcttgaacagcagcccacgcgttgagccctagttgtactgacctgagaggttaggtacgcggctggcgggtggttggccgccaagtgcggtgtggccgcggtggtgattgtaggtgtgcagccaggtggtgaactcttcgcagcgctcagtgtcactgcggtagaggcgggcgtaggcccattcgtctgccaaggtgcggtgaaatctctcgaccttgccgttggtctgtggtcggtagggtcgggtgcggcggtgttcgatatcgcccagggcctgggcaaaaacgcgcgatcggtagcaggacccgttgtcggtcaacactttccgcacgctgatcccacattcggcgaaccaggcattagcgcgtgtccagaactcggcggcggtttctttgatctcatcgtcgagtacctcgctgtaggccagccgggaatatccatcgatggcggtgtggagatagtgatatccccgtattgggttgcggtgcttgctgaacaccccgctgctcttgtccgcgttggagttgtggccgccaatcgcgcgtcccagcatccgccagccgccgccggcagggattttgccgagcttcttgacatcgacgtgcactagatccccgcacccagccggttccatccgccggataatccggccagtagatcggtccagccagcgcagtttggccagcgcgtagcgggtcaatacccgatggaccgtcgagggatgtatccccagcagatacccgatgcgcgctggtccccaccggcggatcacccggactttgatgatgcgccgctcggtgcgcgtgggcgtgcggttggggctgtgatgcggtcgtgagctgcggtcggccattccggcctcgcccagctcgcggtagcgcctggcccagcgctctgcggtggttaccgagacctggaagcgttcggctgctcgccgcagcgaccaaccctcatcaacgacgcaacgggccagccgcagccgaccggtttcagacaatggagcattacggtgggacatgaggacctccgaggtgagtgcgtttcctaagcagctcgcacttcactcggaggttctcgtcatgtcacctcaccacgccgtcaccaacgtccgtggtcagtacacctagtgcacggactagaacatggaggagacgtctgtgacgtacacgatcgccgaaccctgtgtcgacatcaaggacaaggcctgtatcgaggagtgcccggtcgactgcatctacgagggcgcccggatgctctacatccaccccgacgaatgcgtcgactgcggggcgtgcgagcccgtctgccccgtcgaagcgatctattacgaagacgatgtgccggaccagtggagccagtacacgcagatcaacgccgacttcttcgccgagctgggatcgcccggcggggcggccaaggtcgggctgaccgagaacgacccgcaggtggtcaaggacctgccaccgcaaggcgaaggcgactgagcggcccggtgccacaccagctcaggaagcgtcgcccggccgtctcggcggccctgccggagtttccctgggacacgctggccgaggccaaggcgctggccggttcgcatcccgacggcatcgtcgacctgtccgtcggcacccccgtcgacccggtggcgcccgtgatccagcaggcgctggccgccgccggctcggcgtccggataccccgccaccgcgggcaccgcccggctgcgggactcggcggtggccgccctggcccgccggttcggggtcgtcgggctgaccgaggccagcgtgctgccggtgatcggcagcaaggagctcatcgcgtggctgcccaccttgctgggcctggggccggcggacctgatcgtggtgcccgagctggcgtatccgacctacgacgtcggcgcccggctggccggggcgtgggtgctgcgcgcggactcgctgacccaggtgggcccgcaatccccggcgctgtactacctgaactccccgagcaacccgaccgggcgggtgctgggcgtcgatcatctgcgcaaggtggtggcatgggcccgcgaccggggctgcctggtggcctccgacgagtgctatctgggattgggctgggacgcgcagccgctgtcgatcctgcatccgcaggtctgcgacggcgaccccaccgggctgctcgcgatccactcgctgtccaagagctcgtcgctggccggctaccgggccggtttcgtcgccggggacgccgagctgatcgccgagctgctggcggtgcgcaagcacgccgggatgatggtgccgacgccggtgcaggcggccatggtggccgccctcgacgacgacgcgcacgagcggacgcagcggcagcgctatgaacggcgccgggccgccctgttgcccgcgctgcggtcggccggcttcgccgtcgaccattccgaagccggcctgtatctgtgggtcacccgcggcgagccgtgccgggacacgatcacctggctggcgcggcgcggcattctggcggcgcccggcgagttctacggcccgcgcggcgcgcagcacgtgcgggtcgcgctgacggccgacgacgagcgcatcgccgccgcggtgcgccggctcgcctgatcgcaccggctcgcctgatcgcaccggcggccgtgcgggcgtgcacaatgctcggaggcgtctcacataaggacggtgctcgtgaccagttcgaccggcaacctgcgcatcccgctctcgttcggggatgtggccaagcgcgtgtttctgggcaagccgctgatcaccgaggacatcgcgtccgagaagttgtccaatggtgttgcgctgggcgcactttcgccggacgcggtgtcgtccgtcgcctacggtcccgagcagatcctgatcgagctgttgccgcacgcggggctggccgcgttcctgttgctgctgcccatcaccggcgtcatcctgctcatcctggtgctggtggccgcctcctaccggcaggtcgtcatggcctacacccgcgcgggcggctcctacatcgtcgcccgggacaatttcggcccccgggtggcgcagatcgccgccgccgcgctgctgatcgactacgtggtgaccgtggccgtgcagtcggccgccgggacggtcgcggtggtgtcggcgatccccgtgctgggcccctacagcctggcgatcacggtcggcgtggtgctcgtcatctgctacgcgaacctgcgcggattgcgggaagcgggaatgccgttcgcggtggcgacctattccttcatcgtcatggtgggactgaccatcgtgatcggcgtcgtgcgcgcggtcatcggcaacctgccgatctacgatcccgcgcacctggccgggaccgtcccggtccatcagggcaacgggctggtgctgggcgcgacgatcctggtgttgctgcgggccttcgccaacggcggttcgtcgctgaccggggtcgaggcgatctccaacacggtggactacttccgaaagccgcagggccgcaacgcccgtcgggtgctcaccgcgatggccagcatcctgggcttcctgctggccggggtcgcctatctggcccacgtcacccacgccaccccgtacctgaccgaatacccctcggtgctgtcccagatcggccacgccgtctacggcggcggcgtggtgggcgacatcttcttcgtcatggtccaggcgtcgacggcggccatcctgttcaccggcgccaacaccagcttcaacgggttcccggcgttggccagcttcgtcgccgaggaccgcttcctgcccaggcagttgacaaaacgcggtcaccgcctggtgttttcgaacggcatcatcaccctgaccgcgttgtcggtggcgttgctggtcgcgaccggtggctcggtcaacgcgctggtgcccttctacgcgatcggcgtgttcagcgggttcgcgatggccggttacgggatgaccaagcaccacttgacccatcgggaagcgggctggcggcaccggctgacgatcaacctgtccgcggcggtcctgtcgacgatcgtggtgggcatcttcgcggtggcgaagttcaccgagggcgcctggctggtggtcgtggtgttcccgctgctggtgttcgtgctgacccggctcaaccgcgaataccgggccgaggcagccattctcgaaatgttccgcaccgaccgcccggagctggtgaagtacgcgcggcacaaggtgctggtgttcgtcgactcggtcgacctggcggtgatcgaggcgctgcgatacggccggggcctgcgggccgacgagctggtggcggtgcacttcatggtcgacccggcgcacgccgcgcagctgcggaaccgctgggaccacttctcgctcgacacaccgctgcggatcgtggactgcccggaccggcggatcagccggtccgcgcagctgatggtcgccaaggtgcgcgacgagcatcccaacaccaacgtgacggtgctgctgccgcgacggaccttcgcgcggctgctgggccgcctgctgcacgaccggaccgcggacaaggtcgcccgggccgtcagccagatccccgacgccgcggcgacgatcgtgccctacgacgtggaatcgcggatccgggaggcctacccggacacattcgagcaacgcatcgccaaggagctcgacaagatccaggcgtgggtgtcccaggacgaggaccagaaggtcgcggcctacgagcatccggcgcggtcgtcggcggtcatcatggtggccggcctgatctccgggcagcgggccaccatcgaggggcgggtcagcgaggtcgaggacgtcgccgagcgcggcggcacccgccggcggatcgtggtcggcgacagcagcggggagatcacggtcatcttccatcacggccacggcggcgccgacatccagcccgggcagctgttgcggatcagcggcaaggcccgccaggccggtcagcgggaattgtcgatggtcgatccggcatatgaggtgatcgaggatccggcccgcgaagccgaggagtccggggactccgaggaatccggcgactcgcagcgggccgacaagaagtaacactcggcgctgcgggcgcatgaaatgggctgagttccacgcggtttcgctgcacacgtcggcacgtgttccggccggccgctggtgacgcggatgcgtcgcgggcgcgtttccgctacccccgggagaaattcttcactcccgccaagcgggcgtggttccgcaggtaaattgacatctgcacaataactgctgtacgtacttcctccggcacgcgcgaagagacggtgcgcgccggccaggggagtgggcgagaacaggggactgcacattgcctgccgcaactgccacacccgttgccgtcatcggaatggcctgccggcttcccggcgggatcgattccccgcaacgcctctgggaggcattgctgcgcggtgacgacctggtcggcgagattccggccgaccggtgggacgcggacctctactacgaccccgagcccggcgtgcccggccgttcggtcacccggtggggggcgttcctcgacgatgtcgggggcttcgactgcgacttcttcgggatgaccgagcgcgaggccaccgcggtcgacccgcagcaccggctgctgctggaaacgtcgtgggacgccatcgaacacgcgggcctggaccccgcgtcgctggccggatcgcagaccggcgtgttcgtcgggctgacgcacggcgactacgaactgctgtccgccgactgcggcgcggccgagggcccgtacggattcaccggcacctccaacagcttcgcctccgggcgggtcgcctacacgctgggcctgcacgggccggcggtcacggtggacacggcgtgctcgtccgggttgatggccgtgcaccaggcctgcggcagcctgggcggcggcgaaagcgacctcaccctggccggtggggtggtggtgaccctggaaccacgcaagtcggtgtcgggttcgctgcagggcatgttgtccccgaccggccgctgccacgccttcgacgtgaacgccgacggcttcgtctccggtgagggatgcgtgatgctgttgctcaagcggctcgacgacgcccggcgcgacggcgaccgcatcctggcggtgctgcggggcaccgccgccaaccaggacggccgcaccgtcaacatcgccgcgccctcggaaacggctcaggtcgccgtctaccggaaggcgttgcaggcggcggacatcgacgccaccacggtcggcctcgtcgaggcgcacggcaccggcaccccggtcggcgatccgatcgaatactccagcctggccgcggtgtacggaaccgacgggccgtgtgtgctggggtcggtcaagaccaacttcggccacttgcagtcggcgtccgggccgctggggatgatgaaggcgatcctcgcgctgcagcacggcgtggtgccacggaatctgcacttcacccggttgcccgacgagatggcccggatcaacacggaactttttgtgccgcaggagaatacgcagtggcccagcaacggccatcatccgagacgcgccgcggtgtcgtcgtacggcatgtccggcaccaacgtgcacgccatcctggaggaggcccctgccccggaggcggcgggttcggcggcgcccgaagccgttgggccactgctgtttccgttgtcgtccacctccgccgagcagctgcgggtcaccgccgcccggctcgcggcgtggctcgacgagcaggccggcgacgcgcttgccggcccaacgggctggggcctaagggatctgggctacacgctgacgcgccgccgtgcgcaccgcccggtgcgcacggtggtgtcggccagcggtttcgccgaattgcgcaccgaactgcgcgcggtcgccgacggcgacatcccgtatcagcccgccgtgggacaaggcgaccgcgggccggtctgggtgttctccgggcagggctcgcaatggtcgcagatgggcgccgaactgctggacaaggagccggtgttcgccgcgacgatcgccgccgtcgagccgttgatcgccgccgaatcggggttctcggtcacccgggcgctgtcggccccgccggccgtgaccggcatcgacaaagtccagccgacgatcttcgcgatgcaggtcgccctggccgagacgatgaagtcctacggggtgcgtcccggcgcggtgatcgggcattcgctcggcgagtgcgcggccgcggtggtcgccggcgggctctcgctgggcgacggcgtgaaggtcatctgccgccgctcccggctgatggcgcggatcgccggccgcggcgccatggcatcggtggaactgcccggccagcaagtgctttcggaactgtccatccgcggcatctccggcgtggccctctcggtggtcgcctcaccaacctcgaccgtcgtcggcgggggcgccgaggcgatccgcgagctggtcgcggcctggcagcagcaggacgtgatggcgcgcgaggtcgcggtggacgtcgcctcgcactcgccgcaggtggagtcgatcctcgacgagctggtggaggtgctcgccgagctggagccgacggcacccgaggtgccgtactactcggcgaccctgtgaaatccgcgcgagcgaccgtcgttcggcggcgactactgggccgaaaacctgcgccacaccgtgcgattcgcggcggccgtgcaggccgcgctcaaggacggattccgtgtgttcggtgagctggcgccgcatccgttgctcacccatgccgtcgagcagaacgccgccagcctggacgtgccgatcgccgcgctggccgcgatgcgccgcgagcaggagctgccactggggttgcgcggcttcgtcggtgacctgcacagtgccggcgccctggtcgacttctcggtgcagtaccccgccgggcgattggtggatgcgccgctgcccacctggtcgcaccggcggctgatgcttcgccgcgagtcggtgcagcgggcgcacggctcgtcggtccaggcggtgcacccgctgctcggggcgcacgtgcacctgcgggaggaaccggaacggcacgtgtggcagggcgaggtcggcaccgacgcccacccctggctcgccgatcaccaaatccacggtgtcgcagcgtttcccggcgccggctactgcgagatggcgctggcggccgccgccgcgacgctcggtgagcgcgccgaggtgcgcgacgtcacgttcgagcagaccctgctgctggccggccggacggaggtctcctcgacggcgacggtgaccgggcccgggcggctcgagttcaccgtggacacccacgaagacggcgagcgcatccggcgggccggcgcggtcctgcacgccttgccgccagagcacggcggcgagaccgggccgcccgcgcacgacgtggcaacgctgatcgccgaccacccgtcccgcattgagggcgccgagttgcgaaaggcgttcggcgccataggtattcagtacggcccggccttttcgggtctggccgcggtgctggtcggcgaccgggacgtcggcaccgtgctcgccgaggtggcgctgccgggcgcgatccgctcacagcagtcgggttatggcgcgcacccggccctgctggacgcgtgcttgcagtccgtcatcgccgcgcccgagctgcagcgggcggcagccggcggtctgctgctgccggtgggggtgcgccggctgcgcaactatcactcgacgcgcaacgcgcactactgcctcacccggatcacgtcctcgcgtcccggtgagtgcgaggccgacgtcgacgtgctggaccaatccgggacggtgctgctgacggtcgaggggctgcggctggccggcgcggcctccgaacacgaacacgcccaacggctgctcgacgagcggctgttgaccatcgagtgggaagcccgggaattgcccgaggcgccgcagggcgagccgggctcctggttgctgctcagcgcgtgcgacgcggcgtccaacggcgatgacgcgttgacgacgcaactcgccgacgtcctgaaaaccgatggcgcgcaatgccgtaccgtgtccctgccgccgggggcggtgggtaccgaagagctgcgttcgctgctgtccggcggcgagccgggcggcaacggtcaccggccgctgcagcggctcaccggtgtcgtggtggtggccgccgcctccgaggccggccacccggccgcgccgcggcgcggccgggactacgtgtcgcacctcgcgaccgtcgcccgcgagctctcggagctacccggcgaatcgccccggttgttcgtgctgacccgcaatgccgcggtagtcgtcgccggcgatgcgcccaacctgacccaggccgggctgcgggggctgatgcgggtgatcgacgccgagcatccgcacctgagcgccacccagatcgacgtcgacgacgccaccgaccccggacacgttgcgcggcaactacaaagccgctccggagaagacgagaccgcctggcgcgacgggcagtggtacaccgcgcggctgcgccccggcccgctgcggccggccgaccggcgaaccaccgtcgtcgatcacgggcgcgacggcatgcggttgcacatccgcacgcccggcgacctggaatcgctggaactcaccgcgttcgaccgggtgccgcccgggccgggggagatcgaggtggcggtcgcctcgtcgaccatcaacttcgccgacgtcctggtggccttcgggcgctacccgatgttcgagggctaccagcagcaattgggcggcgacttcgccggggtggtgaccgccgtcggaccgggcgtcaccgagcaccgggtcggcgaccgcgtcggcggcctgtccgggaacggatgctggggcaccttcgtgctcgccgatgcccggcacgcggtcaccctgccgccggagattccgcttcgggacgccgccgcggtgccgaccgcatcggccaccgcctggtacggcctgcacgacctggcccgcatcgcgccgaccgacaaggtgctgatccactccgggaccggcggcgtcgggcaggcggccatcgccatcgcccgggcggcaggttgcgagatcttcgccaccgcgggcagcccgcaacgccggcaactgttgcgcgacatgggaattgagcacgtgtacgactcgcgcagcctcgagttcgccgagcagattcgccgtgacaccgacgggtacggcgtcgacgtggtgctcaactcgctgcccggcgccgcgcagcgcgccgggatcgaactgctggccctgggcgggcgcttcatcgagctgggcaagcgcgacatctaccgcgacagccagctggggctgttcccgttccgccgcaacctctcgctgttcgccgtcgacctggcgctgctgacccacagccacccgcacaccgtccggcggctgctgaccaccgtgtaccagcgcaccgcggccggcgagctgccgatgccgcgcaccacgcactatccgctgcaggacgccgccgccgcggtgcgcctggtcgccgcggccgggcacaccggcaaggtggtgctgcaggtgccgcggaccgccagcagcgtggccgccctgccgccggagaaggtgcggccgttccgcgcggacggcgcctacatcatcaccggcggcctcggcggcctgggcctgttcctggccggcgaaatggcttgccgcgacggcgatgtgggcgccgggcggatcgtgctcaactcccgctcgcaacccggcgagcaggcccgccgggccatcgagcggctgcgcgccgccggggccgacatcgcggtcgagtgcggcgacatcgccgagccggacacggccgaacgtctggtgacatgcgcgaccgccaccgggctgccggttcgcggggtgctgcacgccgcggccgtcgtcgaggacgccaccctgaccaacgtcaccgatgacctcatcgaccggtgctgggcgccaaaggtgtacggcgcgtggaaccttcaccaggccaccgcggggcagccgctggagtggttctgcctgttctcctcggccgccgcgctggtggggtctcccgggcagggggcctacgcggcggccaacagctggctggacgcgttcgcccgctggcggcacgcccgcggcgcaccggccaccgcgatcgcgtggggggcgtggtcgcaggtgggccgcgccaccgccctggccgaagacgccggcgtcgcgatcacaccggccgaggggttccgcgccttcgaaacgctgctgcgccacgaccgcccgtatgcgggctacgcgccgatcatgggcacgccgtggctgacctccttcgcgcaacgcagcccgttcgccgaggcgttccggtcggcggggcagggccggccggacgccggcaagttcctcgccgagctgcgggcgctgccgcgcgaagaatggccgtcggccatccgtcggctggtgtccgggcagctcagcctcttgctgcgccgcacaatcgatcccgatcggccgctgtcggactacggcttggattcgctgggcaacctggagctgcgcacccgcatcgaaaccgagaccggggtgcgcatcagccccgccacgatcacaaccgtgcgcggtctggcggagcatttgtgtgacgagctggccgatctgccagccgcgccgccggctggtgccccgcgctagccggccgcgccgcgatcgctgacgtcgtgattgccggcctgccgggcgcagtgcgcgccgcagaacatcgcgccgcccgattcgaccccgtgacccaggatccggcactcgcagtgctcgcaggtcggcgccagctcgaccgcggcgcattccacgctgtcgaacgtggcgctcctgccgtcggtccaggtcaccgtgaacgccttgtcgtagtcgttgccacaggtatcgcagatcgccatcggccgtgacctcctcgaagctggcgaacaggctgtggtgacgggcttcccggcgcgggtcgcgacaaacgtcgaacaccgcgacaccggggcgccgggggaatcgtccgggcggtgatttcggccaccgacgattgggcttacgcccagggggtattgctgccccatgaagaagacggtcgaaatcgaggttgacgtcaacatgattgacgacgccatacgccggttccatctggccgacgcccgggaggccgtcaatctcgcgctgcgcactctcatcgacgacgccggccccggccaccacgacggcgaattcggcgacctcggcccctggcgcggccccgaggacatcgccaccaacaccggctaaccgccgtaggccggccggggcatccggaaagcgcgacgcccgttgcgcagcaccgggacaccggccgagcgatcggcggtgcgcagcgccggcggaattccggggccggcgggcgaatccggcgcggaccccgacaccagccgaaccatgccgcccggctgccgcatcaccgtctcgcccaggggcgcaacgggattcgccgccggccacgccggcggaacggacagcctgcccaccgttgccgcccgccccagcccgcccgacaccgacgggccggcgaccgcggcgggcaggcggaccgctcccgctgcggccttggccgcctggatgttggccaggttgagcccggtgccgaattgtccccagcccaacagggtgcgggccgcggcgaagaacgactgccccggcgtggtgaccacggtgttgaagccgctgaccgagtcgaccaacgacgaccagcccggtggttgcgaatcggcggcgtggctcaccgcggccgcctgggccgcctgcccgtgcgcggtggtggtgcggggcgggtgggtgaacggggtgagcgtggtcgcggccgacgacgccgcggcatagccgtacatggcggtggcgtcctgggcccacatctcggcgtagcagctctcggtggccgcgatcgccggtgcgttctgcccgaagaagttggtcgcgatcagggtggcgagctgaattcggttggcggccaccacatgtggtggcacagtggcggcgaacgcggcctcgtgggcggccgccgcggcccgggcctgcgcggcggcctgcccggcccgcgcggccgtgccggttgcccacgccacgtacggttcgaccgcggcggccatcgcggcggccgcgtcaccggaccacgcggggccgcgcagttcggccagcgtggccgagtaaccggcggcgtagctctccagctgggcggccagctcctcccaggccgccgcggcggccgtcaagggacccgaccccgggccggaatacattctggccgagttgatctcgggcggcagcgccccgaaatcaagcatcggcgatcctttctcagccatcggtgacaccacccgcactgtgggggtgaactgcccagcggttcggcgaccggctacccgccggcggacggccgcggcatcttgaactggcgcggcgcgacccgcagcacgttgttgaccgagggccgcgacaacagcgacgacgacgcgcccgccgccggcgccccgttccacatgccggccgccgggccttcgtgccaagacggcccgccgtcgagttcggcgtccgacagccacagcggttcggcgacggtgccggccgccgggttggtcgccgcccagctctgcgggacggacagtcggccgaccgtggtggcggtgcccgcgccggccacggccgggccggggacgcccgccgccgtcgaagtgccggccgccgcggcggcgccggggacggctttgaaggcttcgcccgccgactgcaggttcgagcggaacagcccggtgccgaaggttccgccggacgtgacggtgcggctgatgccgtcgccgaggttcaccggtgcggtcagggtgttgaaattgtcgaccgcactcagcgccgacgaccccgacgacgacgaggaggagccggaagaccctgcgccggaaagggtttgcagctgatgcgggaccgcggacatggcccgggacagcgaggcgtgcgactggttggccgccgagccggtggcggaccgggccaccgcggcggcctgggcgccgggcccgtcggcgttggtggtgcgcggcggctcgtcgaacggccgcaacctggtcgcccccgacgaggcggcggcgtagccgtacatggcggcggcgtcttgggcccacatttcggcgtaggcgccctcggcctcaccgatggccgcggtgttctggcccaggatgttgctcgcgaccagttgcgcgaacagggcgcggttggcggtcaccaccgccggcggcaccgtggcgccgaatgccgcctcgtaggcggccgccgcggcgcgggcctgaccggccgcctcctcggcttgtgtccccgcctcggccagccaggcgaaatacggggcagcggcgccggccatcgcgaccgaggcactgccggaccaactttcgccgtgcaggcgggtgatcaccgccgagtagccgcgcgccgcggtctccagcgcgttggccaggacgtcccacgccgcggccgcggcgatcagcggtgccgagccgggcccggcatacattctggtcgaattgatctccggcggcagggccccgtagtccagcatgcgtgttcccctcttggtcgagcgattgccgcacccgccgcgagcgattcactgcggcgtgtccgggccgcgcctggccggcaccggcaaccgagtcaatggcttcggtggttgatgtcctcccgcatcacatcgcctgccgcgcgtttgccgggcggctgccgactcgcttcacccgagagccgccgatcgatcgccgcgcgcagcgacgacgagtcccacccctgcgcgccgggccgtcagcgcaccgcagcggacgcgacggcaccgttgcgctccgcctgagtcaaacccaccggcgcccgcccgacaacccctgaaccgcggatgtacagaagattaacagctaacgccaccggcgatccaaacacccgcggcgctgccgaagtgcccgcacccggccgtgattgtgctaaagccccgatcggcgccggccgatcggcaaagccccggccggacggctgtgaaccgcagcgaacaacgggcggccggtgtggccggcgccgttcgccaccaccgtcgggaacgtgtttgctggcgagcccgagttcggggctgccggaacgctgccggcccgcggaataaaacacccgtaaatcggccatctttacttgtgggctggttcttacccggtttgattgctagacaatatggtgaagcgtgtgaccggtgcggcgaggttgccgcgccgcgccgcgcgccggtgccggcgagccaggctccacccggagcgggcgcggcatccggtgacgcacaggtggtaagcggccgttggggtttcgctgccgtccgggaatacaggagtcggaaatgtcgaacaacatcacctggcacgaacacaagatcagccgcggcgaacgcgagcaactcaacggccacaagggctgcgtcatctggttcaccgggctcagcggcagcggcaagagcacggtcgccaacgtggtcgagcagaagctctacgagcggggcatccgcagctacctgctggacggcgacaacgtccgctacgggctcaacgccggcccggatctgctcgaggagcggcacggacccgagttcgcccagcggttcggactgggattctccgcccaggaccgcgaggagaacatccgccggatcggcgcggtggcgaagttgttctgcgaggccggcatcatcgcgctgacggccttcatcagcccctacgtccgcgaccgggacgcgattcgggccaccctcgacgacggcgatttccaggagatcttcatcgacaccccgatcgagatctgcgaaaagcgggatcccaaagggctttacaagaaggcgcgggccggtgagatcaagggattcaccgggatcgacgacccctacgaggccccgccgcggcccgaattgcggctcgacggcgccgccaaggacgccgagacgctggccgaggaggtgatcgcccacctggagcgggtcggcgtgatcgccaccgacggtcttgcgcacacccggggacgcgacgaggtgaccgcatgaactacaccggccacaacggcaagccgctggtggagcgggtgtccaccgagaacgcggcggcccgcatcgagggcctgccgcgggtgccgatctcgaaagccaccgcgcacgaggtcatcagcctgtcctacggcttcttcaccccgctgaccggattcatgggccggcgcgaggtcgacgcgaccctggacgagttcgcgctgccggactcgacgttgtggagcattccgatcgtcttcgacatgtcggccgacgacatcgccgagcgcgacgtcaaggagggcgccagcgtcgttctcgactatctcggggtgcccatggccatcctggacgtcaccgaaatctacgagtacgacctggagcggatggccgaaaagacctacggcacaaccgaccccaggcatccgggcgtcaagaaaacgttgggctaccacaatcgcttcatcggcggcgacatcaccctgatcaacgaaccggtcttcaacgagccgttcaagagcttctggctcacccccaggcagcaccaggacgcgttggcggccaagcactggcaccgggtcgtcgcccatcagacccgcaacgttccgcacaccggccacgaggcgttgatgaagcaggcctggctggccgccaacgaggaccagcccgtcgacagcctcaacaccggcgtgctagtgaacgcgatcatcggccaaaagcgcgtcggcgactacatcgacgaggcaatcctgttggcgcagaacgccttgcgaaccagcggatacttccgcgagaacgtccacatggtgtcgttcaccctctgggacatgcggtatgcggggccgcgcgaggcgatcttccacgccatcctgcgcacgaacctgggctgcacgcaccacatgttcggtcgcgaccacgccggcgttggcgacttctaccatccgtacgactcgcagaacatcctcaagcaataccgcaaccagctgggcatcaagccggtgttcctgcgggaaaactggtactgcccggtgtgtttggaggtcaccaactcggccctgtgcggccacgaggcgcaggcgcagagcttcagcggcagcctgatccgcagcatcctgaccgacgaagtcaagccgacgcagaaggtgatgcgccacgatgtgttcgaggtcgtgatggagtgcgccgccaagcacggtcagggttcgccgttcgtcaccgaggagtatctggccaacaggcttccggtcttcacactcaaccagctggagggctcatgagcagcgaccacgacaacaacggcaaggcgatcaagatcaacgtctggatcaacgaggagcggctggaggcgctggccaacgcggggatggccgagctggccaacgaggcgttcgcgggcatgaagctgctggagatccacaccaccgaagagcagaaaaacattgttctgcaacggtttccgggggcgaagtacgactcgcccaccacccggtccatcgagctgctgcccaagcaggccaaggaccggctgttggagctgtcgatcgcgatgcattccaccggccccgacgtgatgggccgtttcctggaggagaccgagccggcgtagcgccggacgctcagccgtccaaccggatgaaggcaccccggaggtagtgctcgacgcaggccgcccgccggatcttgccgctggtcgtggtgggaatcgatcccggggccaccggcaccagatccgcgacgttgagcccgtgcgaattcgagatcgccgcggtgacttcgtttttgaccgcgtcgagcttgcgccgcgcgtcctcgtcggaatcgccgcgccgcttcagctcgatgatggtgaccaatttctcggtctcgtccgccggcaccgagatggccgcgacccggccgccggtgacggcctgcaccgtcgactcgatgtcctcgggatagtggttgcggccgtagacgatcagcaaatccttcatccggccgacgatgaacaactccccggcggagatgaagccgaggtcgccggtgcgcagccacggctgccgcggggtgcccggcgacgggttgaccagcacgccgccgaaggtgcgtcgggtttcctccggtttgcgccaatacccctgcgccacgttctcgccgttgacccagatttccccgaccgttccgtccgcgcgttcggtgttggtgtccgggtcgacgatccgcaccgtcggcgacgtcggcgcgccgtagctcagcagcggcgacccggtctgcgccgggcaccgctgcgcgctgccggccgacagcttttccggctcgaagtggacgacctcgggtccgccggcctcggcgcggctggcgacgtagaccgtcgcctcggccaggccgtaggagggctgcatcatgtgctcgtgaaagttgtacggcgcgaagcgtttacagaaccgccgcagcgttgccgggtggatgcgctcggcgccgctgacgatgctgatgatgttgcccaggtcgacgccggccaggtcggcgtcggtcgtcttgcgcacggccagctcgaaggcgaagttgggcgccgcggagaagaccggatccgcccgcgacatcgcctggatccagcgcgcggggcgctgcaggaacgcgaccgggctggtgaggtcggcggggtagccgcccaggatcggcgcgatgacgccctggaccagccccatgtcgtggtagaatggcagccacgacacgcagaccgtattgcgcggggccaccccgtcgaagtcggggaagaacgcggccatcagctgctggaagttcacctgcaggttgcggtgcgagaccatgacaccggccggcaggcgggtcgagcccgaggtgtactgcaggtaggcgatgtccggggccgcgctgatccggatgctcgacgaattcggttcatccaggtccagcgagtcgatttcgacgacggccggggcgggcccggtgtccggccgacgaaggtattcggtgacggtcgcggcggccgcggcggtggtcagcaccacggcggggccggtgtcggccagcacggcgctgacccgttcgtcgtgcgaaccgggctggggcaccgacagcggaaccgcgatcagcccggcctggatcgcggccaggaacgccacgatgtaggacaggccctggggcgcgagaatgaccgcccggtcgccggtgtcgccgtgccgcgcgacctcgcgggcgaggttcgacgtccgctgatagagctgggcccaggtcagcgtctcggcgacgcccgcccagtcctgctcgtaatcggtgtagcggaacgccacatcgtcgggttgcaggccggcacgttcccgcatcagggacaccaccgacgaaccgtgcatgcgggttaggttaccgctccggggttttcgcgccggcccgccgccgtgcggggcgggcgtgcggaccgggacaccttagactggtgcacgccaatagcgttgtgcacgttactgtttcgatccatcccaggtggccggcatcatcggcgcgcgcggggcgtcggcgaactcgtcgagcaccggcgcgcttagtcccgccggtgcggcggccgcgcgtttggccgcggttccggcgaaccccagcgtcggcgcacccagctgcgaggcggtcgtcgacggctcgggatccagatactcgtagccgcggccgagctgtttggccgcggcccggtggcggcgccgctgcgtcgactcttcctccggctgcgccaccgcgggggcctcgacgttttcgggcgcggccgcctcgcgtctgcgggcgccggcgctcgcggcccgccgcgcgtccgcggtcaggccgccgaccaggtaggcgaggctgtgcagggtggccaccggcggccccgacggggtgggcggcggcgcgccgggtgcggccgcggcgggcgccgccgcggacgtcggggccggcgccggcgcgggggacggggccggtgccggcgcgggcggcggactcggtgccagcgccaccgggacgagcgttcggcgccgggacgaacgggggcaccggaatggcatgcagcccagccaaacccgtcaagcccgccaaaccaccgaccagggtgggcacgaccaacgggaccaccgagacggtcagcagcggcagaatcgccgggatcagcacgatcatctgctcgagcaacgtcttgatcaacgcgatggtgtcggtgatgacggtgccgatcacctcgatggtggtgaacagcagggtccacgcgatggtcgcgggattgcccgacgcgaacgccgcggccagatccgccgcgacgaagctgaacatctgcgccaaatagccgaagtacgaaccgaaatccatcgggtagccgagggcgaacgcgatgttgaacgggttgaggaagctcagcggattgcccagcgacggcagccacgggtcgaagccggagaacagcgaccggaagaacgggttgttcatcaactggtcgatcaacggctggatgtagcggttgtagaagtcgacgaacccggtcttctccagccagtccagccactggtcctgcgtgtcgggcggatacgacgacgactgcgcggccctggccgccggcgcggcggccgccatcacccgcggcgccggttcggtgtgcggcgtggccgccagcgcggcggccgccacgtcctggtaggtgcccatcaccgtggccgcctggacccacatccgggcatagtcggcctcgttcaccgcgatcggaatggtgttgatgccaaagaaattcgtcgcggtcaacacggcgtgtgcggcgtggttggcggccagctcgggcagcgtcggcatcgccgccagcgccgcggtgtaggcggcggcggcgacttcctgctgggcggccacggccgcgctgtcggtgctcgcccgcgccagccaggccagatagggggcgtgcgcggccaggtaggcgccggccgtcgggccgtcccagtcgccggcccgcacggcgcccagcagcgtgaccagctcgtcggccgactcggcgtactgcacgctcagcgagctccacgccgccgcggcggcgagcaacggcccgggccccggccccgcgctcagcagcgacgaatgcacctccgggggtgaggccatccagatgggggcggtcatcgaccgcacccccgcaaaacccttgccgcagcgggggtatggacgaaacgggcgcgccgttggggcgccgaaacggtggcagcgtcgacgacggccacccatgccggacaggacatggcggtgacagctctctcggggtacatccgccccgggtcgcaggacgcgatgacgcgagtgtcctggctctcggatcgccgctcgcctcgccttccagcttgtcagccgtggccgttgagggtcgctccccgatgacagtggcgggaccgcgccggattcgcaccggcttcctgcatcgtcatcaccttacgggtgacattcttgcatccgccccggcggacccgtcggcgaatcgggcgtttgtgtcagcgttcggcaacccgcaacgccagcgcgaacagcagccgcacctcggggtcggccagcgacaccgacagcagcttctcgatccgccgcacccggtagcgaaccgtattggggtgcacgcgcaacgcgtgcgcggccgcggcgatgtcgccgaaggcgtccaggtaggtccgcagcgtctgggccagcaccggttcccggtcgtgcagcgccacgatccgcggatcgaccaaccgctcgtcgcggccgaccagggtgacgatctcgtcgagcaggaccgtggtgcgcgcttcggccagcgacgtcacctgcccgaacgaaaggggatggcgctcagcgctgtccagcacgcggtccacctcggcgcgcgccgcggcgaccgcggaaaggcccgggaccggcgcggcgatgaccgcccgcagctgcaccccgagctcggcgcgcagcgcggcgatggtgccgcgcacccacgagctgaccgaccggttcggcggctggggcagcagcacgtaggtccgcgagccgtgaccggcgacgtgggcgtcgtgccggaaagcgctggcgctcagcgcgatcacatcggtcaggcgggtgtggcgggacgcaccctctgccgccgcccaaccgatcagggccgcgcagccgtccgcggccagaccgagctcggcggcgatcgcggtgaggtccacgggcgcaagggtttccgagtcggtcacaccgagcagctgctgcagccgccgcgcctgggtggacgggcgggccgccagccgcgccatgatccgggcggccagcaccgcggcgccgcgcagtatctgttcggcgtcgtcggccagcggctgcgcgccctgctgcacccagatggtcccggcgaacaccggcggtcgccgggcatccgggtcgggctgatggatgccgaccgccagccggggtcgcagccccagctccggccgctcggcgacgcgcaccacctgggtgcccgaccgcagcgcgtcgaagatgccccactggccgatccactcgagatgctcgggcgggccggcccggcccaggatggacagccggcgcagctcgtcggcctcgtcgttggaggccgaataggccagcacctgggattgggcgttttcgatgctgaccatgccgtggatgcgctcggccagtgactgcgccaacccgaacaggtcggtgcccgagtcgtccgccgcgtcggcgcggtcgccgtgatgttccagcacgtgattgaccaactggtacagccgttcccagcgggcccgcggatcgacggccaccaccgccgatcccgccgcgacggccgtgccgaccagggcgtcggacggctccttgacgaagacggccaccggtacccggtcgcgggcctgggtgtcgatccagcgcagcgcctcgtcgtcgccgacgcccagcaggaagaagacgtcggcggagcccgccgccgcggccagcccgagccgcacatcgtcggagtcgatcagcgccgccgacgcgaccggttggtccagcccacgcggggcgtcgaccaggctgaccatggtcgcgtccagcgcgagcagcagctgacccagcccgacaccggccatattgtccgatcttactacaatgaccggcctatcttgtcggatcggctaaatcgcggcgtggccgccgcgaggatcctgggcagcatggatgcgatcactggaatttccgaggtgccggtgccggctaacgagccggtccacgattacgcgccgcgctccgcggagcgcgcccggttacgcgccgagttggccgcgctggccggccacccgatcgacctgccgcacgtcatcggcggccgccaccggatgggcgacggtgaacgcatcgacgtcgtccagccgcaccggcacgccgccaagctgggcaccctgaccaacgccgtgcacgccgacgcgaccgcggccgtcgacgccgcgatggccgcgaaaagcgattgggcggcaatgcctttcgatgagcgggcggcggtgtttttgcgggccgctgatctgctggccgggccgtggcgggagaagatcgccgcagcgacgatgctgggccaatccaagtcggcctatcaggccgagatcgactcgccctgcgagcagatcgacttctggcggttcaacgtggcgtttgcccggcagatcctggcgcagcagccgatcagcgggccgggggagtggaatcgcagcgactaccgcccgctggacggctttgtctacgcgatcactccgttcaatttcacctccattgccggcaacctgccgaccgcgccggcgctgatgggaaacaccgtggtgtggaagccgtcgatcacccagaccctgtcggcgtatctgaccatgcagttgctcgaggcggccgggttgccgcccggggtgatcaacctggtgaccggcgacgggttcgcggtttccgatgtggcactggcggatcggcggctggcgggcattcacttcaccgggtcgacggcgaccttccagcggctgtggtaccaggtgggcaccaatatcggtcactaccactgctatccgaggctggtgggcgagaccggcggcaaggacttcatcgtcgcgcacgcctccgcacgcccggatgtgttgcgcaccgcgctgattcgcggggccttcgactaccaggggcagaagtgctcggcggcgtcgcgggcgttcatcgcgcagtcggtctggcggcggatgggcgacgagtttctggccgagaccgccgcattgcgctacggcgacgtcaccgatctgaccaacttcggcggcgcgctgatcgaccggcgggcctttgtcaagaacgtcgacgccatcgaacgcgcgaagggcgcgccgcacgtcaccctcgcggtgggcggcgaatacgacgacagcgaaggctatttcgtgcggccgacggtgttgctgtccgacgacccggccgacgagtcgttcgcgaccgaatacttcggcccgctgctgtcggtgcacgtgtatcccgacgacgactaccagcgaatcctcgacgtggtcgacaccggatcgcggtacgcgctgaccggtgcggtcatcgccgacgaccgggcggcggtgctggccgcgcaggaccggctgcgctttgccgccgggaacttctacgtcaacgacaagccgaccggggcggtggtggggcgccagccgttcggcggttcgcgcggctcgggaaccaacgacaaggccggctctccgttgaacctgctgcgctggacgtcggcccgcaccatcaaggagacgttcgtcccggccaccgaccacacctatccgcacatggcggccgactgatggccgggctgttcgcccacaccctgcgtccggcgatcctggccgcgggccggcgaccggggttgcgccgggccgccgaagcgctgccggtcacccgccgggtggtgcaccggttcatcgccggggagacaatcgattccgcgctggacagcgtgacggcccttcgtgattcgggacgctgcgtcagcgtcgaccatctgggcgaggacgtgtcggacgccgacgacgccgatgcggcggtgcgggtgtatctggagctcgtcgaccgcctgggctgcctcggcgatggggcggccgtccggccgctcgaggtgtcgctgaaactgtccgcgctgggccagtcgctggatcgcgacggtgagaagatcgcccgggagaatgcgtgggcgatctgcgcggccgcgcagcgggccggcgtgtgggtgacggtggacgccgaggaccacaccacgaccgattcgaccctgcgcatcgtgcgcgacctgcggcgcgaattcgattggctgggtgtggcattgcaggcctacctgcggcgcacgctcggcgactgcgaggagttcgccgccgccggcgcgcgggtgcggctgtgcaagggcgcctacgacgagcccgcctcgctggcctaccgcgatcccgccgcggtcaccgattcctacctgcgctgcctgcgggtgttgatggccggttcgggctatccgatggtggcctcccacgatccggcgatcatcgaggcggcgccgtcgctggcccgcgaatcagggcgtggcaccggtgaattcgagtaccagatgctgtacggcatccgcgacgacgagcagcggcggctggccgaggccggccacaccgtccgggtctacgtacccttcggcacccagtggtacggctacttcatgcgccggctcgccgaacgcccggccaacctgacattctttttgcgcgcgctggccgcgcgtcggcattgagtgtgcggtccggggcttgcggagttgcatcaggtcgacgacacgccgacgatgcccgccgccgctacacactcaacgccgaggatgcacactcaccgtcgccgcgggcgctcgctggcgaacccgcgcaccacatgcgcgcgtacgaattccgccgtcacgtcgggatcgtccaggttcagcgtcggcgacggtgtgctgaacaacgagaacaggatgcgcgcgaaccattcaccggccgcctcgacgtcgaggtccttgcgcacctcaccggtgagccgggcggcggccagatacggggcgaagaactccacgcattcgcgcagcagcacggcggcgtccttggtcagcagcaggctgatcgcgtcctcgtcaaagtacttctccgaagcgatgactcggcgggcctgggtgacgaacaccgccgccgcgcagagcctctcctcgagcgtgccgccgcggtccatggccttggccatctcgcggtagaaacgctccgacgcgtgttcggcgcaggcctcgacgatcgcggccttgtcggaaaagtattcgtagatcgtgcttctcgacacgccggcctgcttggcgatgtcgacgatggtggccttctgcaatccctgcctgccgaaacacgtgaacgcggccgcgacgatcagctcgcgggtgtcggtcgccggggtcgcgtcggtcgacatggaatcagcgcgcctttccctcagccggccggcgcgaggatcagaccactcgtgggcacgccggttcccgaggtgaccagcacgtgctcgacatcggcgacctggttgtgggaggtgccgcgcacctgccgcaccgcctcggtgatgccgttcatgccgtggatgtaggcctcaccgagcagcccgccgttggtgttgatcgggaactcgccgcccagcgacaaccgctcgacggtggcgaaatccttggcctcaccgcggccgcagaagccgagttcttcgagctggacgaacacgaacggggtgaaatggtcgtagatgaaggcggtttggatgtcctgcggcttgcaccccgaatcccgccacaactgccgcgcgaccacccccatctcgggaagcccggtgatgtcgtcgcggtagtagctggtcatcatctcgccgtcggccgccgcgccctgggcggccgcggcgatgacggccggcggccggcgcaggtcgcgggcgcgttcgacgctggtgacgaccagcgcgaccccgccgtcgctttcctgacagcaatccagcaggcgcagcaccggttcgacgatccagcgcgaattctggtggtcttccagggtgatcggccgctggtagaaccacgcgtcgggattggttgccgcgtgcttgcggtccaccaccgcgatccggccgaagtcctcgttggtcaccccataggtcgacatgtagcgctgggcatgcagcgcgacccacgccgcgggggtgagcagcccgaacggcgcgtaatgcgccatgaacaacggggtttcggccatgttgcggccactgccgccgaaccggaagccggagcgttcgttgaaggcgcgccagcacaccaccacgtcggcgacccccgtcgccacggccatcgcggcgtgcaccacggtgccggccgccgcgccgccgccgtggtgcacgcgggagaagaagctcaggtcgccgatgcccacgttgcgcgcgatgtcgatctcgtcgctggaatccatggtgaaggtgaccatgccgtcgacgtcggaggacgtcagaccggcgtcgtccagcgcggcgctgaccgcctcgcacgccaattgcagttcgctgcgcccggattccttggagaactccgtctggccgatcccgacgatggccgcggcgccgggcaagatgctgctcatgagcccgcaccgtcgagcaggctgagcaccgcggtgccggagacgtgatcgccgaggctgttggacgccttgaaggtcacctcgacgaagttctcagccggcggtggccctgccgggccacgagtcttgccggtgacgctgccggtgaaccgcagcgggtcgtccggaaagcacggcacgccaaggcgaatcgacagcttcttgaccatcgcctcgggcccggcccagtcggtgaggaaccgcacgcagtagccgttggtggtcaggatgttcatgaacaggttgggagaaccctgcttcttggcgtagtcgcggtcgtggtgcaccggcatgaagtcgcgggtggcgatcgcgccggcaacgatcatcgtcgtggtgatcgggatttccagcggcgtgacctcctcgccgaccgaaatgtcctgccatcgcaacgtgcggttggcggtcctcgtcatgcgtgtccttccgaataggttgcgccgaggtgggccagctgcgccgaagccggaccgagggtgagctcgttgtgcttggcccacaggaaatagcggtgcaggggataggtgacgtcgatgccgatgccgccgtggacgtgctgggcggtggcggccacccgagcgccggcctcggcggcccagaacttcgcgatgcgcgccgcccggtcggcgggccggccgtgggcgaccagccaggccgcctgccaggtggtccaccggatcgcctcgacgtcgatgaaggcgtcggccatccgctgctgcaccgcctggaagctgccgatcgggcggccgaattgctcacggcccgtggtgtatttggccgcgatgcgcagcgcccgctcgacgacgccgagctggatcgcgcacagcgccaccagcgcccgggtgagcagtgactcgaccagtccaatgccggcgatccggtccgtctcggaaacacgtgcgccggctaagaatacgtccgcgtgcggttcgcgattcgtggtgggcaccgggcggatctcgacgccggcggcgtcggcggccagcaggaacaggcccacgtcgccgtcgtccaggacggcgggaatcagcatcgtgtcggcgagttgggcggccggcaccaactccttggcgccgtcgaggcgccagttcgggccgtcgcgacgcgcggtggtggccgggcgggccggatccgaacgaccgggttcggccaaacccgctgtcaggatgcgcgatccggcgatcacgcccggcaagacccgctgctgctgttctgagctgccgtgccgggcgatcgagtcggcgcccaacaccagcgtggcgtaagcgggcaccggcgcgacgccgtagcccacctccgccagcagcaccccgagctccacgaagccgccgcctgaagcacatgagcctccgaccgcctccggcagcgcggcaccgagcaggtcggcggcggccagctcttcccagagcgcggcgtcgtggcgggtgtcgccgacctccaactcggtcagccgttccggggtggcgcggcgctcgaacagatcgcgggccagcttgccgatcgtctcctgctcttcggtgaacgagaagtccatgacgggcctatgcgctcggccggaactggtgcagcaccaggttttgcgagccgtcgaaggtttggtagtagacctcgaccggcagtccgggcgtcacctcggccgggtcgatgccggtcaggttggacaccagccgcaccccctcctcgagttccaccagcacgacgatgtaggggtactcgaaaaacggaaacttcggctcgtgcggcatcacgtagctgtacacggtgccgcggcccgacgactcgacggcctcccagtccagcgaccggcagtgcgggcacatcgggcggggtgggtgacgcagctgcccgcagccgctgcagcgttggatcaggagtttgttctcccgcaacccgttccagaagaattcggtgtctgcggtgatcgccggagccagacgggccgccatcagccggccggcctgaagcgcagcacccggaatcgctggcgccccaacacctcgccgttctggtcggtgtaggtcgtcagccaggtcaggaagaagccggtgcccagggccgtcttcttctcgtcggagaccgactcgtagacggtcgtcgcgctgatcacgtcgcccagcctcgggtatcgctcgatctcgaactccgagttcgtcgccaccgtgctggtgtagccggcctcatcgaggaaagccgttggactgctgtcgatttcgacgggcgccccaccgcgctcgccgattccctccagcttcggcgacggcatggtccaggtctgcaacatcaccggcggcgagacgatgccgccgaaccgtgacgacgcggcgaactccggatcaaggtagacggggttcatgtcggccatcgcgtacgcccagtgccggatcatcggctggttcaccgggtcgggtgccagcgagggttttccggtgccgccggtcggctggccgaccagggcccgcaccttggcgctgacggtttctgagtcggtcacttcggtcctgtcctccttgctaattcgcggcccgaaggtcgcggggtgcgcggggcatgcccaacgcggccatggcgatgatgtcacgttgaatctcgttggcgccgcccccgaaggtgttgatgacggcctgacggtaggcggattccagcgcgccacgcagcggagcctcggcgccgcgccgcaccccgttgccgtcgagcacctcgagcagctcccgggcgacctgctgcgtgagctcggtgccgaacaccttcgcggccgaggcttctcccatgttgagcgcacccttcgtcatcgccgcgttcacccgcaggttgacgagcttgtaggcggccacctgcgcttcgacccgggccagcgccgatcgcacccagggctggtcgatgacccggccgccgtcgagttcggtggacagcgcccagtccagcgtcttgtcgaacagcggctcgagcgcgcccaggttgcccagggcggcgcgctcgaagttcaactgcgtggtgatcagctgccagccctggttctcggcccccaccagcgcgctgaccggcacccgcacgtcgtcgtagaacgtgtagaaggtcgagatgcccggcatggtgtgcagcggttgccaggagaatccgggcgaggaggtcggcacgatgaggatggaaatgcccttgtgcttcttggcatccggatcggtgcgcacggccagccagatgtagtcggcgtaggcggcgccgctggtgaacatcttttgaccgttgatcacatactcgtcaccgacacgcacggccgtcgtgtgcaccgaggccaggtcgctgcccgcccccggctcggagtagccgatggcgaattccacggtgccgtccaggatcgccggcagaaaccgccgcttctgctcgtcggtgccgtagtgcatcaacgtcgggccggcggtgttgagcgtcaccagcgggatgggtgcgctcacccggcgcgcctcctcggcgaagatgaactgctcgatggccgaaaaccctcgtccaccatactctttgggccatccgacacccagcaggttggccgccgccagggcgcggacgcattcgcgcaccgcgggaccgccgtccatctgctcgctgaccgcggcgacgcgttcgggcgtcatcacggtctgaagcgtcgcacggatctcggcgcgcagctgctgttgctccggcgtgtattccagatccatcggctcaggcccccattcgcaccggcatgcgtttcaccccgggcaccatggtggcccgcattcggtccacctcgcccaccagctcgatgcggggataccggcgcagcagctcctcgaagaacaccgtcgcctccagtcgcgccaattgtgcgcccacacaagaatgttcaccgcagccgaaggcgatgtgcgggttcgggtggcgggtcacatcgaattcctcggagtccgggccgaatacgtcctcgtcccggttggccgacccgtagagcatcaccaccacctcgccggcgcggatccgctgtccgcggatctcgacgtcggcggtcgcggtgcgggccatgtgtaccacgggactgttccaccgcaacatctcctcgaccgcaagcgggatgcgggcgggctcctcgacgagcaggcggtattggtcgggatgcgcgatcagggccagcgtccccagcgcgatcaggttgcgggtggtttcgttgccggccaccagcagcagaaaggcgaagttgagcaggtcttcgtcggtcaaccggtgctcgtcgatctcggcctcggccagcaccgagagcaggtcggcgcgcggtcgcgcgcggcgtgccgcgatcagccgctggaagtactcgtagagttgcccggccgccaccgccgggtccagctcgatctccgggtcggccgtcccggtggccgcatccgaccacgcccggaattgctcccagtcgtcgggcggggccccgatcaattcggcgatcatccgggtgggcaggggagcggcgatctgttcggcgaactcgtgcacggcgccgcgttcgatgccgtcgagaatgccgcgcacgatcttgcggatcttcggttccagcaccgaaacacgccgccgggtgaatccggagttgatcagcttgcgcagctgccggtgccgcggcggatcggtgaagatcaggctgccctgctgcaccgggttgggcagctgcggatccgggatcgtgatgccccgggtcgaggtgaacagagccggattgctcgacacgaaccggatgtcctcgtatttcagcagcgcccagaagttggtgacgtcgttccagcacaccggcgccgtcgcgcgcagctcccggtaggcgggatacgggttacccgcgtagaagtccggggaatgcagcgggaagctcggcgagcgcagcggcggatgagtctgcacggcaagcccctctcgcaggacacccgatccgacagattggttcaatctgtctgccgactgtgtctactctgcgccgccgcgtgctgtcaacacggtgccaaagtagagggatagctcgattttcacgcgaaggatgattgacgggcgacacgcgggggtatacaccaagtgatcagatgaccggaggaagcaacatggccgatccgcccgctcttgtccagacctaccagctctacatcgacggccagtgggtcgagccgcaggacggtcgctacgacgacctgtccccgtccaccgaggccgtcatcgccaccgcacccgacgcgagtgtggcgcaggtcgacgacgcgatcgcggccgcgcgccgcgccttcgacagcgggccgtggggccggatgtccgccgagcagcgcgcccggtgtctgaaccagctgggcgaggcgctcaccaagcacgccgacgacttcttcgcgctgtcccaaacggagtggggctgcatcggcaacgagcgcatcatgcagatcgacggcgccgggttcatgtccctgcacgccgcccagctcgcgacccagctggtcgaccaggaggtcgccggcatcagcgccggcaccacgttgttgcgccacgtgccgctgggcgtggtagcggtgctcacgccctggaacttcccgcactgcctcaacgtcatgaagctgaatcatgcgctggccgcgggcaatacggtcgtgctcaagccgtctccgctgacaccgctggccgggctggcgctggcgcgcctcatcgacgagcacaccgacatcccgccgggggtggtcaacgtcgtcacgccctcgggggttgaggcggccaagctgctcaccaccgatccgcgcatcgacatggtgagcttcaccggcagctcggccgtcggccgccaggtgatgtcggcggccggcgacacgatcaagcgaatcctgttggagctgggcggaaagtcggccagcatcgtcctcgacgacgcgaacgtcaccgacgaaatgctggaacagatgctgttccaatcctgttcgctgcatgccggacaggcctgcatcctgcacagccggctgctgttgcccgattcgctgcacgacgacgtcgtcgatcggctggccgcgttggcgcgcgaggtcaaggtgggcgaccccaccgatcccgacgtgcagatgggtccgctgatcagcgcggcgcaacgcgaccgggtcgaggcgcacatcgcgggcgcacgcagcgacggggccacgctggtcaccggcggcgggcgacccgccgggctggacgtcggctactacgtcgaaccgacgatcctgtccggggtggaacccaattcgaccatcgcgcaagaggaagtgttcggcccggtgttgtcggtactgcgctaccgcgacgacgacgacgccgtcgccatcgcgaacaactcccgatacgggctctccggtgcggtgtggggtgacgacgtggatcgcgccgtcggcgtcgcgcgccgcattcgcaccggccagatcgcggtcaacggcatcagccctgccggcgcgccgttcggcggcttcaggctcagcgggctgggccgcgagggcggcggaatcggcgggctgcaccagtacatggagccgatggccatcggggtccccgcgtgacggcaccccttgcggggctgcacgtcgtcgaaatcgccagcgagatctcgggtccctacgcgaccaagctccttgtcgatctgggcgccgaggtcatcaagatcgagccgcccgccggggacccgctgcggcgctggggcccgttcgcctcgggcgttgtcgatccggaccggtcgggcctgttcgagtacatcaacgccggcaaacacgctgccacgcttgacttctcggagactgccgacgtcgcggcggcgcgggaactcatcgcccgggcgcacctgctcattgacgactccggacccgcaacgctgcagggatacgggctcgggcccgacgacctgcagcggatcaacccaaacctggtgttgctgcgcatctctgggttcggccagaccggaccgttccgccgccgcccggcgacaccgctgaccctgcaggcggcatcgggctggatcagctcccgcgatccgcagcgtccaccggttcaggtcggcgcccggatcgccgagtacgttgccggcgcctacggcgcgctgggcgcactgaccgccctgcgttcacaccccgccgggcacgtcaccgaagtcgatgtctcccagctggaatcgttgctgtccacgttgccgtatccgatgttgatggcccagcggatgcgacggctcgggctgcccgccaacctgcggtcggcgcccatgctgggcgtggtgcgggccgccgacggctgggtcggcatcaactgcctgacgggccagcactggctcgacgtctgcgcgatgctcggcctgcccgagttcggcgagcaccagctcgcgatcatgctgggcggcccagagcgcgccgacttcttcgccaaagctgagccggtacttgccggccagaccgtcgccgagatcgtggaactcgctcaggcgctgcggattccggccgcgcccgtcaacgacggcgccactgtgctcgattgcccgcaatacgccgagcgggggttcttcgtcgacaccgggtcgtttcggcggcccgggccgccattccggttctcgaaaacccctgtgccgcagccacgtccggcgccactgtctggggcgtcgcgaacgacgtggaccggtgacggccgagcgctgcaccgagcgcccgggccgctgcccttcgccgggctgcgggtgctcgacctcaccacgtactgggccggtgcctacctgacctgctacctcggggcgttcggcgccgacatcgtcaaggtcgagtcgatccagcgccccgacgggcaccgctattcgggggcgttcgcctacgagggcgacgactggtacgagcgcagccccatctggcagggcaccaacctcaacaaacgcgacctcacgctggacctgacgtcgccgcggggcctcgacctggcgcggcggctggccgcccgggccgacatcgtggtggagaacttttcgccgcgcgtcgtcgagaacttcgggctggactacgactcgctgacggcgctgaaccccgacgtgatcgtggtacggatgcccggctacggcctgcacggcccgtggcgcgactacgtcggctgggcgctgaacttcgagcagaccgccggaatgtcggccgtcaccggctttcccgacggcccgccgtgcaacccccagggcccggccgatccgatcgtcggcgtgcacgccggggtcgcgctgctggccgcgctcgagcaccgcaaccgcaccggcgccggccaactcgtcgaggtggcccagatcgaggtcgccgccgcggtcaccgccacaccggtcatcgagtactcgatgaccggtgtggtgcggcctcgggagggcaaccgccggcgcggctgcctgcagggcgtctacccgaccaacgaggaagaagtgtgggtggcgctgtcggtgcccggtcggccgatcgaccacgacgccttcgacgagctcgtcgccgcctggacccgcacgcagaccgccgcggcgatcgtcgaaacccttcaggcacaagggatcgcggccgagcgggtgatcaccggcgaccagatgtacgatcccgagctgatcggggcccagctggacgtgcgtggctactacgaggagctcgagcaccggatcaccgggccgcaccgctaccccgggtggccctttcgcatcgcgcccggcccgcggcggcaccaccgcaccgccccgccgacgctcggccagcacaacgacgaggtgctgcgcgagctgggcctgtccgaggcggagatagcggacctgcgtcagcagcgggtcatcggcgagcgggtgctcaacgcatagctgccggcaacgcatgccgggccctttgtaaaccgcgcgtgacatgccaagctgctcgacatggccatcgagatcgcccgccccaaactcgagggaaacgtcgccgtcggtgaggaccgccagatcgggttcgccgagttcggcgacccgcaggggcgcgcgatgttctggttgcacggcacccccggcgcccgccggcagatcccggtcgaggcccgcctgtacgccgagaaccataagatccggctgatcgggctggaccgcccgggcatcgggtcgtcgacgccgcatcgctaccagaacatccgggcgttcggcgaggacctgcggaccatcgcggacacgctgggcatccacaagatggccgtcatcgggctgtccggcggcggcccctacgcgctggcgtccgccgcggtgctgcccgaccgggtcgtggcggccggcatcctcggcggcgtcgcgcccttcctcggcgacgagggcatcaccagcggcctgatgaacctgggcaagcgggtggctccgctgctgaagctgggcggcgacccgctgcggatcggcgccagcctggtcgtgcgggccatccgcccggtcgccaaccccgccctgtacctgtacgcggcgatctcgcccgagggcgaccggcggctgctcacccggcccgagttcggggccatgttcctcgacgacctgctcaacggcagccgcaagcaactggccgccccgttcaacgacatcatcctgttcacccaggactggggattccggctcgaccaggtcaaggtcccggtccggtggtggcacggcgacagcgaccacatcgtgccgttcgcgcacggacaacacgtcgtgtccttgctgcccgacgccgagctgttcgtgctgcccggcgagagccacctcggcgggctgggccgcggcgaggagatcctgtccaccctgaccaagatctgggacgagcagaactgacccgtgccggtggcgggtagcctgctggcgtgctgctgacgtcgctgaatccctcggccgttaccgccaccgacatccccgacgcggtacgcatcgacggcaccgtgctcagccgcgccgacctgctcggcgccgcgacctcggtggccgagcgggtggccggcgcgggccgggtcgccgtcctcgccacaccgaccgccgccacggtgctcgcggtgaccgggtgcctgatcgccggggtgccgttcgtcccggtgcccgccgacgtcggggccgccgaacgccggcacatgctggccgactccggggtgcgggcctggctcggccccctgcctgacgagcccgacggcctgccgcacgtcccggtgcggctgcacgcccgctcctggcaccgctaccccgagccgtcaccggacgccaccgcgatgatcatctacacctcgggcaccaccgggctgcccaagggggtggtgctgagccggcgcgcgatcgccgccgacctggacgccctcgcggaggcctggcagtggacggccgacgacgtgctggtgcacgggctgccgctgtttcacgtgcacggtctggtgctgggcctgctgggctcgctgcggatcgggaatcggttcgtccacaccggaaaaccgaccccggccggctacgcgcaggcccgcaccgacttcggcggcaccctgttcttcggggtgccgacggtgtggtcgcgggtggtggccgacgatgcggccgcccgcgcgctgcgcccggcgcggctgctggtctccggcagcgcgccgctgccggtcccggtgttcgaccggttggccgggctcaccgggcaccagcccgtcgaacgctacggcgcctcggaatcgctgatcaccatctccacccgggccgacggcgagcggcgccccggctgggtgggcctgccgctgaccggcgtgcagacccgggtggtcgacgacgacggcaacccggtgccgcacgacggggagaccgtcggcaagctgctggtgcgcggcccgatgatgttcgacggctacctcaaccggcccgacgccaccgccgaggcgttcgacgccgacggctggtaccgcaccggcgacgtcgccgtcgtcgacgacgccggcatgcaccgcatcgtcgggcgggagtccgtcgatctgatcaagtccggcggctaccgcatcggcgccggcgaaatcgaaaccgcgctgctcggccaccccggcgtcgccgaggccgccgtcgtcgggatgcccgacgaggacctggggcagcgcatcgtcgcgttcgtcgtccccgccggccgggtcaaccccgacgacctgatcgaccatgtcgcccaacaactttcgatacacaagcggccccgcgaggtgcgcgtggtggacgcgctgccgcgcaacgccatgggcaaggtgctcaagaagcagctgctgtccgacggctgagcgggcgtcgtgatgcacgacacgcagcaacttgccagcttcggggccgagcgtggccgccacgcttcacctaccgtcgtaaccgtgcattcaggcaaccggagcgcaggcggccaccatgggtgagccgtccgtgcgcgccaccacgcccggcacgcccatgcggcggatagcggccgcctgcctggtgggttcggccatcgagttctacgacttcctgatctacgggaccgcggcggcgctggtgtttcccgcggtgttcttcccgcggctcggcccgaccgtcgccaccatcgcctcgatggcgaccttcgcgacggcctttttgtcccgtccgctgggcgccgccgtcttcggctacttcggggaccggctgggccgcaagaagacccttgtcgccaccctgctcatcatgggcgcctcgaccgtgagcgtcggcctagtgcccagcaccgcgtcgatcggcatcgccgcgcccctgctcctcaccgtgctgcggttgctgcaggggttcgcggtcggcggcgaatgggccggctcggtgctgctgagcgccgagtacgccccgaccgaccggcgcggctggtacggcatgttcaccctgctcggcgggggcaccgccgggattctggccagcctgaccttcctcgccgtcaacctcaccatgggcgagcacagcccggcgttcatgcactggggctggcgggtgcccttcctgatcagcagcgggttgatcggcatcgccttgtacgtgcggctcaacatcgacgagacgccgatcttcgtcgaggagaaggcccgccatctggtgcccaaggcaccgctgaccgaactgctgcggttgcagcgacgcgagatcatcctggttgcgggcagcttcgtgggcggcatgggcttcatctacctgggcaacacgttcctggtgatgtacgcccacaaccatctcgggtactcgcgcagcttcatctggggcatcggcgcgctgggcgggctcaccagcatggcgtgcgtggcctgctcggcgtggatctccgaccgggtcgggcgccgccgggtgatgctgtggggcctggtcgcgtgcctgccgtgggcgttcgtggtcatcccgctgatcgacaccggccgacccgtctgctacgtcgtcgccgtgctgggcatgttcggcaccgcggcggtggccaacggccccaccgccgccttcgttcccgagctgttcgccacccgctaccgctacagcggcgcggcggtggcgatgaacctggccggcatcgtcggcgccgccgtgccgccgctgctggccggcacgctgctggcgacctacggcagctgggcgatcgggctcatgatggcctccctggtgctggccagtttcgtgtccgtgtatctgctgcccgaaacccgcggggccgcgctggacgccgccgcggccgccgagaaggtcgccgcccgctagctcagttggcgtgcaggtcctcgttgagggtgatgccggtgccgccgcgggccaccacctccaccgccccggtcagcgaattgcgccggaacaacaggttgttgccgccggacagctcgcgggccttcagctgcttgccctcgggcgtgatgaccttggtgcccgcggtgacgtacaggcccgcttccacgacgcagtcgtcgccgagtgaaatgcccagcccggcattggcgcccagcaggcaccgcttgccgatcgagatgacctcggtgccgccgccggacagcgtgcccatgatcgaggccccgccgccgatgtcggagccgtcgcccaccacgacgcccgccgagatgcggccctccaccatcgaggcgcccagcgtgccggcgttgtagttgacgaagccctcgtgcatcaccgtcgtccccggcgccaggtgtgcgccgagccgcacccggtcggcgtcggcgatgcgcaccccggtcggcagcacgttgtccaccatccgcgggaacttgtcgacgccgtagacggtcaccggcccgtgccggcgcagccgggcccggaccgcctcgaatccctcgatggcgcacggtccgcgattggtccacaccacattggtcaataccccgaacaagccgccggcgttcagcccgtgcggcgccaccagccggtgcgacagtagatgcaaccgcaggtaggcgtcgtaggcgtcggcggccacgtcgtccagcgagccgatcaccgtgcgcaccgcgacggtctcggtgccgcggtcgtcgtcgcggccgatcagcgcggtcagctcgggcgggacgtcggacagcgcgagccgcgacgtgccgctggtgcccggcccggtcagttccggtgcgggaaaccatgtgtcgaggatcgatccgtcggcggccagcgttgccaggcctactcctgcggcacctgctgctgttgtcacggcggtcaggttacttcccgggccgcacccgaatccgcccgccccggcggcggtcgcggccggccgtgcggtcgcggtccggcccggcgcgcctacaccggcgtcaaaagctcaccggtgcaaggtaattgagcgacgtcgcggcaccggcaccgcacggtgtgcgtccggtccgtcgtcgtgccaggtcaaccgcgtgaactcggccgtttcggggtacctcggtcccgtggatcggccggtcatgtcctgggcctggcgggggagtcacggtcgcgggcccgcaacggggccggctcgtcgagagaaggagattctcaatgacgttgtcaagccgccgcggtagtggttgcggggtggtagacagcgtggtcgcgcagcatggcccacaggacgttgaggcggcggcgggccagggcgaggacggcttgggtgtggcgttttccttcggtgcgttttcggtcgtagtaggtgcgcgaggaggggtcggtgcggatgctgaccaaggccgacaggtagcaggcgcgcagcaggcgccggtcgtagcgtcgggggcgtttgaggtttccgctgatgcggccggaatctcgtggtaccggcgccaggccggcgacgccggcgaggcggtcggcggaggcgaatgcggccatgtccccgccggtggcggcgaggaactcagcgcccaggatgacgccgaatccgggcatgctcaggatgatttcggcgtggcggtggcggcgaaatcgctcctcgatcatcgcgtcggtgtcgccgatttcggtgtcgagggccatcacctccttggccaggcgggccaccacagtggccgccagttgttggccgggcacgatgctgtgttgggcgttagcggcctgcagcgcggtggctgcgacggtatcggcgttgcgggccttgcgtttacgcaagaacgcggctactcgagcgccaccggcgctgcgcagcgcgtcgggagtttggtagccagtaagcaggatcagcgcggcacggctcttgttgtagtcgaaggcgcgttccagcgccggaaagtattccagcagctgggcgcgcattcggttgatcgcccgggtccgatcagccaccagatcggaacgtcggctggtcaggatgcgcagctcgactgcgatgtcatcgccggcgcgcagaggctgcaagtcgtggcgcatccgggcctgatcggcgatgatcgcagcgtctttggcgtcggtcttgccttcgccgcggtaactacccgcggcgtgatggaccgtgcgcccgggaatataaagcagccgctgcccggcagcgatgagcaaggcgatcagcaacgcggcgccgccggcgttgaggtcgatcgcccacgtgacctcgcctccatcggccaacgtcgtcaccgccgcaatcaactccagcagcgcggcctcgtcgttggccacccgctgcgagagcaatcgctgcgcgtcgtcgttaataaccatgcagtaatggtcggccttaccggcgtccacgcccgcccagacaggttgtgccacaaccacctccgtaaccgtcattgtccagatcaacccagcagacgaccacgccgacgtgtccttacacagcgatccaatcgcatctctcaattagcggtcgagtcgtcgcgggacgccgggcggccaatctccttcggccatccaacacagcaaccacatgaaagccatacccgacgtccctgggcaattcgaagcctaaggccgacggccccgaacacccttcaagaaaggtaaggaacatcatgtcctttgtcaccacccggcccgaggcgctgctggccgtggccagcatgctcgaaggcctcggctcgtcgatggatgcccagaacgcggcggccgccgcgcccaccaccagcatcgcgccggcagccgccgacgaggtgtccgcactgcaggccgcccagttctccgcctatggcacctggtaccagcaggtcagcgcccaggccaaggcgattcaccagacgctggtgcaaaacctggacaccaacgccgattcgtacggcgcgaccgaggccgccaaccgggtgaacaccagcgccgcggcgttgcaggggttggcgcccaacgtgatccccaacgccgcaccggcggccgacccgccgcccgcggggaccaccagcctgggcacctccatcggctgggcgcagaacgtgggcgcggccgcgtcggacttcatcaccctgggcgaggggcaattcgccccggtgcccggtgccgcggggatcccgaatttcaaccccgggctcaccgcggcgacgacggccggcccgcccgcgccggcggcgcccgccgccgcggccggcgccccggtgctggccagcatgggccgcgggccctcgatcggcggcctgtcggtgccgccgagctgggcgccgggcggcgtcgccccggcggccaacgccaccccggcgcagctggtcggcgccggcttcaccagcgccgcgcccgacaccgccccggtgaccgcggtgccgggcggggtgccctcgatggccaccgccggccgcggcggttacggcctgggcgccccgcgctacggcgtcaagcccaccgtcatgcccaagcccgccatctagagcaccccagaacaggagcgagacaatgactttcgacttcggagcactccccccggaggtcaactccacccgcatgtacaccggggcgggcgccgcgccgatgatggccgccgcggcggcgttcagcaacctggccgacgagttgagcaccaccgccgcggccacccagtcggcgatcgcgaacctgaccggcgaggagtggatgggcccctcggcggcagcgatggtcaccgccgtccagccgtatgtgcagtggatgcacaccaccgccgggcagctgcagcaggcggccgcccaggccatggcctcggcggccgcctacgagaccgccttcgccatgacggtgccgccggcgctggtcgcggccaaccgcgcccaactggcggcgttgatcgcgagcaacgtgctggggcagaacgccgcggcgatcgcggccaccgaggcgcaatacggggagatgtgggcccaggacgcggccgccatgtacggctacgccgcgtcgtcggcgaccgcgggcaagctcagcccgctgacctcgccggcgcccaccaaccaacccggcgggctgggcgcccaggccgccgccgtctccggggcgaccgccaccagcgcgcagacgagcgggctgcaggggaccgtcgccaacgtgcccaacgtggtgcgcacactggcggcgccggcggacccgccggggctgaccgcgctggacaacctgctgggcaacccggtggtgaacaacgtcggcaacgccggcttcgacgtggtgtcctggaacgtgttcaacaccatcgtgtccaacatcctctacaaccacaccctcgacaccgccgccgcggccggggtggccggtgaggtgggcggcgcggtcggcggcggcgcgctggtcggtgccgcggcccccgccaccgcgggtgtgggcgccgcgccggtgctggccagcatgggctcggccgccacggtcggcgaattgtcaacgccggcaacgtggtccgcgcccacaccggagcccgccgcgacgaccgtcggggccaccgagtgggccagccccgccgaggagccgcacaccgcctgggccaccggcatgccggcggtggcctcggccgggcgcggcggctacggcatggggccgcggtacggcgtcaaacccaaggtgatgcccacccggttgccggtctgaccggcggcgcggggcatcgcggccagggtccagccactaccctgggagcgtgctggacttgaccggggacccggttgcgctgaccgcggcgctggtggacatccccagcgaatcgcgcgacgaggcgcggctggccgacgaggtcgaggccgcgctgcggtcccagacgtccggtttcgagatcgtgcgcaacggcaacgccgtgctggcccgcaccgaccgcgggcggcggtcgcgggtgctgctggccgggcacctggacaccgtgccggtcgccgggaacctgcccagtcgccgcgaggacggcgacctgtacggctgcggcacggcggacatgaaatccggggatgccgtcttcctgcatctggccgccaccgtcgccgacccggcgcacgatctgacgctggtcatgtacgactgcgaggaaatcgacgccgccgcaaacggattgggtcgcatccagcgcgagctgccggactggctgtccgccgacgtcgcgatcctgggcgagcccaccggcggctacatcgaggccggctgccagggcacgctgcgggtggtggtcagcgccgccggaacccgcgcccattcggcacgatcctggttgggcgacaacgccattcacaaactgggcgccgtgctgcagcggctggccggctatcaggcccgcagcgtcgacatcgacggctgcacctaccgtgagggcctgtcggcggtgcggatcgacggcggggtggcgggcaacgtcattccggacgcggcggcggtgacggtcaacttccgcttcgcacccgaccggtcgccggccgaggcgctgcagcatgtgcgcgacgtgctcgacggcctcgacgtgcacatcgaacagaccgacgccgccgcgggcgcgctgcccgggctgtcccagcccgccgccaaggcactggtcgaggccgccggcggccgggttagggccaaatacggctggaccgacgtggcgcgcttcgccgcgctgggcataccggcgctcaacttcggccccggggatcccaacctcgcgcaccggcgcgacgaacgggtggcggtcgccgccatcaccgccgcggcggacctgctgcgcggctacctgagcggctgagccgccgcgccccggcgcgcctgcgcggcggcgtccgcggccgcggcgcgcatcccgatcgacgtcagctcccccgacaccgccagcagcgccgcttcgtcgccggccgccagcgcccgcgcgtgggccaacgcgattctcgctgcggcgcagtcgatctcgtcgcacaaccgggccaacggttcggccgctcgggtgtcgccgagccgcaccgcctcatgccagacgcgcaccgccaccgcccgctgaccgccgcgctcggccatccgggcggcatcgcgcgcggcggccaccgcgccgtgggcgtcacgcatcagggccagccgatgcgcccgcgccaccccgagctcgggcgcgaacagcgccgacttggtgccatgccgggtttcggcccggctcaatgcctttgccgtggcggcggtgtcgcccagctgggccagcgcggtggccagcagggtcagcgacaacggcccccacgagtaaccggtgcgctccaaggtggccgcggccggacccaataaccctgccgcagaagcgaattcgccctcggcgagcagcacgtgcgccagcagcacctcgccgatcgcgcggcccggctgctgcagctcggcgaaatcggtgaactgctgcgcgagttcgcgggcctgctcgagccggcccgccagcaacagcgtggtggtctgcgccagcccgatggtgaagcgcagcagcccgggatgttcggcggccaacgctcgccgcgccaacggctcgacgtcgtcgaaccgcccctgccgcgccgcgcacaacgcggccgcgctgcccgaccaggccaccgcctggtcgtcggcggcgggcgagccgagcacctcgccggcgaccttgacggcgtgcccgacgttgcccgcgttcatcgcgaaggtggcgctgagcgcgtccagggtggtgcgcgggccggggtccgcgacgcggttgcggacggtgcgcaggaaggcggtggcccgctccggctcgctgagcatccagaactggttcgccgcccgcagcagggcccagtccatcagcgcggcctcggtcaagccggtggagtcgacctcggccagcagcgcgtcggcctcccggccgcggccctgccagcccagcgcatgcgccaggcgccagccgcgccgccaggccgccggagcgccgcagggcggcgcgggccagccgttcgcccagcgccaggtcgcccagccgcagcgcctgccgcgcggcgtcgacgacgtcggcggcccgcggcggcgcgtcgctgtccagcgccagcgacaccagccgcagccggtcgctgagccggtcggacggatgccgctccagcacggtgaccagctcggtgcgtcgttgccgggcatcgtcggggtccagcgcggcccgcacccgctcggcgaacagcgggtgcgcggtgtacaccaccgggtcgtcggacgtcccgccgcgcatccgggtctccgccgcgccccaccgttgcgcctcggccaccgcgccgtcaccggcgagcgcgttcaggtcggtgaccgacagcggctcggcgacggccaggtattccagcaccgcgtgggccggcggcgtcagctcggcgaggaaggcgtcgatctcgcccggcgacgtcggggcatcgggcgcctcgacgtcgattcgggtgagcaggccgtcgtcccacagcgccgcgatggcgtccggggcgccgtcggcgcgggcggtgacgatcagccgcgccgcgccggcgcgggccagctggtacaccagggtcgccgacagcacgtccagctggtgggcgtcgtcgacgaccagcagcaggccggcgtcgccgagtgaggcccgggcggcccgcagcagcgcggccggcttgccgatctcggcgatccgcaccaggtggctgaacgccccgaacgggaccgcgcgttcggtcggcgtgccggtcacccagcggacccgggtgccggggtgcgcggcggcgaaccgctcggcggccacccgcgccaaggtggatttgccgatgccgtcggggcccaggaccaccgccccggccgcggcggcggtgtcggccaacgccgcgtccagccgctcggcggccgtcgcctgtcgggggacgttccatcgaatcggcacggccggattttatggcgcgcgggcccgccgccacggcgaaagccccagatatgacgggccgcgcggggttggtctacgtttgtcggatatgcccgcagaacgcgattcgtcggccgcgtgggcggtgtgtgtgtactgcgcgtccggcccgcagcatcccgaattgctcggtgtcgctgcggaactgggcgaggcgatcgccgagcggggctggacgctggtgtggggcggcggccgggtgtcggcgatgggcgcggtggccagcgcggcccgggcccgcggcgggcggaccgtcggtgttatccccacggtgctgatgcgccgcgagatcgccgacgccgacgccgacgagctgatcgtcagcgacaccctgcacgagcgcaaacagatcatggaggaccgcgccgacgcgttcatcgcgttgcccggcggcatcggcaccctcgacgaggtgttggacgcgtggacgacggggtttctcgggctgcacgccaaacccatcgtgctgctggacccgatcggccactacgaggggctgtggctgtggctgtccggattgctggacagcggctacatcacccaggcggcgatggaccgggtggtcctggtcgacaaggtgggtgccgcgttggaggcgtgcgcgcccggctgagcccgacgaccgcgccgccgccgggctaggctgtccgccgagcttgccttctttttcctacaagatcgagtccgaccaggatcgagttcctacagaatcgaggggatcaggtgtccgatcgtgacgggggagcgcgcacggcggtcaaactgaccgacatcgcagctcgggtgccgaccgtgctggccgacctgccggtgatcgcacgcggcacgctgaccgggctgctggcccagcccggctcgcacaagtcgatcggcaccgtgttccaggatcgggccgcccgctacggcgaccgggtcttcctgcggttcggcgaccagcagctgacctaccgggacgccaacgccgccgccaaccggtacgccgcggtgctggccgcccgcggtgtcggccacggcgacgtcgtcgccatcatgctgcgcaactcgcccaacacggtgctggccatgctggccgcggtcaagtgcggcgcggtcgccggcatgctcaactaccaccagcgcggcgaggtgctcgcgcacagcctgggcctgctggacgccaaggtgctcatcgccgagaccgatctggtcagcgcggtggccgagtgcggcggctcgggcagcaccgagaccctgaccgcggaggacctggagcgcttcgcggtcagcgcgccggccaccaacccggcgtcggcgtcggcggtgcaggcccgcgacaccgcgttctacatcttcacctcgggcaccacgggattccccaaggccagcgtgatgacgcacctgcgctggctgaaggcgctggccgcgttcggcgggatcgggttgcggctgaagagctccgacaccctgtactgctgcctgccgctgtaccacaacaatgcgctgacggtggcgttgtcgtcggtgatcaactcgggggcgacgctggcgctgggcaagtcgttctcggcgtcgaagttctgggacgaggtgatcgccaacgacgccacggcgttcatctacatcggcgaggtgtgccgatacctgctcaaccagccggccaagcccaccgaccgggcgcaccgggtgcggctgatcgccggcaacggcctgcgccccgagatctgggacgagttcacccagcggttcgggatcgcccgcgtctgcgagttctacgcctccagcgagggcaacgccgcgttcatcaacgtgttcaacgtgccccggtccaccgggatcttcccgctgcccctggcctacgtcgagtacgaccccgacaccggtgccccgctgcgcggcgacgacggccgggtgcgccgggtgccgcccggacagcccgggctgttgctcagccccgtcaaccggctgcagcccttcgacggctacaccgaccccgaatcgagcgaaaagaagttggtgcgcaacgcttttcgcgacggcgactgctggttcaacaccggtgacgtgatgagcccgcaggggctggggcatgccgcgttcgtcgaccggctcggcgacaccttccgctggaagggggagaacgtggccaccacgcaggtcgaggcggcgctggcctccgacgggtccgtcgaggactgcacggtcttcggggtcgaggtgccgcgcaccggcggccgcgccggcatggccgcgatcaaactgcgcgacggcgccgagttcgacgggcgctcgctggcccgcaccgtctacgagcagctgcccgtctacgcgctgccgctgttcgtgcgggtggtggactccatcgagcagaccaccaccttcaagagccgcaaggtggagctgcgcgagcagggctacggccccgaggtcaaggacccgctgtacgtgctggccggccgcgacgagggctacgtgccgttctacgacgaataccccgacgaggtcgccgagggcaagcggccctaaggcggcggtgcgacctggccctgcgcgccctcggccgaccaggcaccatagacccgtgcaatcgacgttctgcgggcgtccggtcgccggtgatcgcgcgctgatcatggcgatcatcaaccgcaccccggactcgttctacgaccggggcgccaccttcagcgacgacgccgcccgggcggccgtgcaccgggcggtggccgagggcgccgacgtcatcgacgtcggcggcgtcaaggccgggcccggccaggacgtcgacgccgacaccgagatcgcccggctggtgccgttcatcgaatggctgcgcgacgcctacccggaccagctgatcagcgccgacacctggcgtgccgaggtggccaaggtggcctgcgcggccggtgcggacctgatcaacgacacctggggcggcgtcgacccggcgctgccggaggtggccgcggagttcggggcgggcctggtgtgctcgcacaccggcaacgcgctgccgcgcacccgcccgttccgggtgagctacggaaccagcacccgcggcgtggtcgacgacgtgatcgcccaggtcacggcggccgccgagcgggcggtcggctgcggcgtggcccccgaccgggtgctgatcgaccccacccacgacttcggcaagaacaccttccacggcctgctgttgttgcggcacgtcggcgatcttgttaacaccggatggcccgtgctgatggctttgagcaacaaggacttcgtcggggagactctgggtgtggaattgaccgagcggctggagggaacgttggcggccaccgcgctggcggcggccgccggcgcccggatgtttcgggtgcacgaggtcgcgcccacccgccgggtgctggaaatggtggcctcgatccagggcacccgcccgcccacgcgcacggtgagggggctcgcatgacgacgtccgacctggtcgccggggagctggcgggcgacgggctgcgcgacacccggcccggcgacacctggctggccgaccgcagctggaaccgccccggctggacggtcgccgagctggaggccgccaaggccggccggaccatctcggtggtgctgcccgccctcgacgaggaagacaccatcgggtcggtgatcgacagcatctcgccgctggtggacggtctggtcgacgagctgatcgtgctggattcgggctccaccgacgacaccgagatccgcgccgtcgccgccggcgcccgcgtcgtcagccgcgaacaggcgctgcccgaggtgccgatccggccgggcaagggcgaggcgctgtggcgttcgctggccgccagccgcggcgacatcgtggtgttcgtcgactccgacctgatcaacccccacccgatgttcgtgccgtggctggtcgggccgctgctcacgggggacggcgtgcacctggtcaagagcttctaccggcggccgctgaacgtcggcgacgccggcggcggcgcgggcgcgaccgggggcgggcgggtcaccgagctggtggcccggccgctgctcgccgcgctgcgcccggaactgggctgcatcctgcagccgctgggcggcgaatacgcggccacccgggagctgctcacctcggtgccgttcgccccgggctacggcgtggagatcggcctgctggtggacaccttcgaccggctgggcctggacgcgatcgcccaggtcaacctgggggtgcgggagcaccgcaaccggccgctggccgagctgggcgcgatgagccgccaggtcatcgcgaccctgctgtcgcgctgcggcatccccgactccggggtggggctcacccagttcgtggccgacgggccggagggacagagctacacccagcacacctggccggtgtcgctggccgaccggccgcccatgcaggcgatccggccccgctgaccggcgacccgggtcggcggcgctgtcggcccgatagggcagtatcgatcacgtggcgttggtgttgctgtacctggtggtcctggtgctggtggcgatcgtcctgttcggcgcggccagcctgctgttcggtcgcggtgagcagctgccgcccctgccccgggggacgacggcgacggtgctgcccgcctacggggtgaccgggtcggacgtcgacgccgtcaagttcacccaggtgctgcgcggatacaagaccagcgaggtcgactgggtgctggaccggctcgcccgcgaactcgaggcgctgcgcggccagctggcggccgcccacgctgcggcgggcgaacagcagagcgggggccaatccgcggaacccgacgacggcgcggatcgtcaggactgaatgtgagtgacgacgagccgatccgctgcggctgggccaccgcgcggtccgggcccgatttcgagctgtaccgcgactaccacgaccgggaatggggccaaaccgtgcgcgacggggtggccctattcgagcggatgagcctggaggccttccagagcgggctgtcgtggctgaccatcctgcgcaaacgggagaacttccgccgcgcgttctccggtttcgacatcgacgccgtcgccgggtacaccgacgccgacgtgcaacggctgatggccgatcccggaatcgtgcgcaaccgcgccaagatcgaggccaccatcgccaacgcgcgcgcggccgccgagctgggtggcggcacgcagctggccgagctgctgtggtcgttcgcgccggccccccggtcccggccggccgacgcgtccgaaataccctcggccactgccgaatcgacggccatggccggtgaactcaagcggcgcggcttccgcttcgtcgggccgaccaccgcctatgcgctgatgcaggcgaccggcatggtcgacgaccatattcgcggttgctgggtgcccgcggcggtgcgctgagaacacagatgtgggtctttgtacaagtgatgacctggatagggaacaatagaggggtgattaggcagttcgatgccgggcatggctggaagttcgctggcggggcgtgcccggcgccgaccaggctcgcgagggcgggccagctcgaacctggagggagcactcgatggcggcgatgaagccccggaccggagacggtcctctcgaagcgacaaaggaggggcgcggcatcgtgatgcgggtaccacttgaaggaggcggtcgactggtcgtcgagctgacacccgacgaagccgccgccctcggtgacgaactcaagggcgtcacgagctccagctaggagcctgctgaattaggggattttttggggcggggcgtctcgaaccgtctagcggcgtgttgtagtcagaccctgtgggtcgacagaaaagagatcgccccgccgttgttgagcgtggcagcggtcggcggctgaggcaaggccttggtgtgagggcgtgttaggcgatggcccaggtggtgtcggtgcgggtcaggcccatggtgagcagccgacgtaggttcagtgctgcggcgcggtggtgcagccaatggttgtttttggcggttcctcggtagcggaccttgcggttgccgcgagtgagccaggccattgagcgttccaccatgggccggtgttggcggtattcggcttgccaatcggggtcgcgggccgcgacgcgagcagcgcgcaataattgctcgtggatatgaagggtgagtttgcgtccgcgcgtggcggtcgtgcaccgggacgccaacgggcatgagcgacagtatctttcgaaggtgactccgccactgggacggatcggcattccgtgtccagccgggcaggtcacgatgcgggcgtcgaaatcgatgaggaaatcgtcgctggtgaagccacccggaaccggcgagcgtagcggtagcggtttgatcaccgcgacatggccggcgtcggccagtgccgcccgggcggccccggtgccatacgccgaatcgcccaggacccgcaccgggggtgtgttcaccctcgagcaggctcagcccgacgacggcctcgtggttgtccgcgccgctggccttggtcaacgcgcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcgccagtgcccgtcggtgccatcagagccctcgaccggttcaacgtcttgaccggcgatcaacgccaacaacgccaccgcctcagcagcccgcggcgcgagttcctggtcaggcagatagcccagcacccggtgagcatcaccgaccaaaccatccaccagccgatcccgagcggccttatcctcccacgcaatcgcgggtttccccggatcgtcgtaatcatgggcgctgcagtgggcttcgatcaccgctgcagcgccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgtcttgaccgcctcgaagatccggttgggccgatccgaagccgccaaccgacgccgccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggccatcacctcagccggcacgctgggccggccccgctgcgacgggaacaagtccgcgaacatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatccccaaaaccccaggacaactcgtcccgccacgcggaattaattcagcaggctcctagagcgtgccgccggtccagtgtcggcggcgctatgcacacactttccgatagatctccagggtctgctcggcgacgtgggcccaggagaactcctcgacgcagcgctggcgtcctgccctgccgtagcgctgcgccttttcccggtcggcgatgagctcgttgaccgcctcggccaatccggcctgatagcccgccgggtcgcgcgggtcgtaatgcaccagcgagccggtgaccccgtcggcgaccacctccgggatgccgccgacgtcggaggccaccaccggcgccgcgcaggccatcgcctccaggttcacgatgcccaacggctcgtacaccgaggggcacacgaaaaccgatgcggccgacagtatttcgcgtagttccccgatgggaagcatttcccggatccagaacacgccggtgcggccgcgggccagggcggccaccgcgtcgcggatctcgtcggcgatttccggggtgtccggcgcaccggcgcacaacagcacctgcgcctcggggctgaaccggtgcgcggccgccaccagatgcgcgagccccttctgccgggtgatccggcccacgaacaccaccaggggccgggccgggtcgacgcccagttcggccagcatcgatccggtctgcaccgggccggcgggataccagacgtcggtgtcgacgccgttgcggatgacgtgcaccgcactgggatccagtgccgggtagacccgcaggatgtcctcgcgcatcgcggagctgaccgcgatcacggcgtgggcggccagcaccgcggtgtgctcgacccaggtcgagatccggtagcccccgcccagctgctcggccttccaggggcgcagcggctcgagcgaatgcgcggtcagcacgtgcgggatgtcgtgcagcagcgcggccagatgcccggccatgccggtgtaccaggtgtgtgagtgcacgacgctggcctgcgcggcggcgttggccatcatcaggtcggcggacagggtcgacatggccgggttggcgccctgcagccgcgggtcgggctgatgcacctgcaccccggccgcgcccgggcgtagagcacccatgcagtgcacgtccaccgcgcacagccggcgcagctgggtgacgagttcggtgacgtgtacccccgcccctccgtagacctccggtgggtattcccgcgtcatcatcgccacccgcatacccgcaccgtagttcggacgcggcggggcccgcgagtcgggccggggcccactttcgccggtgatccgtttgccggcgcggccaattaccttgacggacagccgcacagaacatcgccaatagcccgttccccctggcagcgctttgccgcggccgataggtttgaagccatgagggaagcaccacacgtgctgggcatcgtcctggccggcggtgagggcaagcggctgtatccgctgaccgcggatcgcgccaaacccgcggttcccttcgggggcgcctatcggctgatcgacttcgtgctgtccaacctcgtcaacgcccgctatttgcggatctgcgttctcacgcagtacaagtcgcattcactggaccgtcacatctcgcagaactggcggttgagcggcctggccggcgagtacatcaccccggtgccggcccagcagcggctcggcccgcgctggtacaccggctcggccgacgcgatctaccagtcgctgaatttgatctacgacgaagaccccgactacatagtggttttcggcgccgaccacgtgtaccggatggaccccgagcagatggtccggctccacatcgacagcggggccggcgcgacggtggccggcatccgggtgccgcgcagcgaggccaccgccttcggctgcatcgactccgacgagtcgggccgcatccgcaagttcgtggagaagccgctggatccgccgggcaccccggacgatcccgagacgacgttcgtgtcgatgggcaactacattttcaccaccaaggtgctgatcgacgcgatccgcgccgacgccgacgatgaccattccgatcacgacatgggcggtgacatcatcccgcggctggtcgacgacgggatggccgcggtctacgacttcagcgacaacgaggtgcccggcgccaccgaccgggaccggggctactggcgcgacgtggggacgctggacgcgttctacgacgcgcacatggacctggtgtcggtgcatccggtgttcaacctgtacaacaagcgctggccgattcgcggcgagtcggagaacctggccccggccaagttcgtcaacggcggctccgcgcaggagtcggtggtgggcgcgggcagcatcatctcggcggcctcggtgcgcaactcggtgctgtcgtccaacgtggtggtcgacgacggggcgatcgtggagggcagcgtgatcatgcccggcgcgcgggtggggcgcggcgcggtggtgcgccacgccatcctggacaagaacgtggtcgtcgggcccggcgagatggtcggggtggacctggaaagagaccgggagcgcttcgccatcagcgccggcggcgtggtcgcggtgggcaagggcgtctggatctaaggtcgccatcgcaccgcgagcagacgcaaaaacccccaattcttcggcgtgtcgggtggttttgcgtctgctcggcggctcaggggatctcggggatcagcagatgcgcgtcgcggcgcggaccccagtgcaggctgacgcgaccgcgcggcgagttctggtaggcggccgggatctggccggtgagcggattggtcgggcacagccagcgcccggcgaccaccagccgcaggtgctcgccggcgcggaacagcgtcgccgacgggcccagcgcgacgtcgaccgcgacgacctcgcccgccgcgacgggttgcggatcggtgcaggccgcgacgggctgtcccggccgcgacagccgggaatcgagggcgcgcagcgaaactcgttgccagccggtgctgacccggtcgcggccgtagccgtaggacccttcgaacgcgacgaagcggtcgcggaaccggccggggcgccacttctccacgccgacgaacaggttcgcgtcgtcgcagccgtgcagttccacccacagccgggcggccatcggcccggtcagttccacgtcgtcgggcacattccaggtgaaacatgctgcgcgggaacgtgttccgaatgtcaccctgcccggctgtgcggccgggtcggttctcagcaccccggcgtcacccagatgcagtgcgcgccagcgggttcgggccagcggccattcggattcttcgcgcaccgccgtgacggtgtcgcggtcctcgcgtacctcgaggcgcacgctgcgagcggccggggccccgtccagtacaccgcgaaagaagctcagctgttcggccagcgcctcctcggcgtaaaaggtcgcccacttgccgccgcgatgggtgtagagccgggcatgcgtcgagctgctgtgcgtgaaggcgcgcagcgagccgcggctgtgtaagttgttgtcggagaagctgccacagaccagcatgggcacggtgatcgccgacaggtcgggcaccagcgagcgccagaactcgtcgcgcagcgggtggcggtcctgcatgtcctgcaagtcgtaggcctggcgggtatcgcgtcgcacattgcgtgaccacattcggatgaagcccaactcgcgcacgccgccgggaaacatcaggtcccggtaggcgtcggtgaagccctcccacgggcagatcgcccgcagcgccggcggctgcagggcggcgaccgcgtattggctgatggccaggtaggacacccccagcatgacgacgttgccgtcgctccacggctgcccggcgatccactgcaccaggtcgtaggtgtcctcggcctcgcggtgcgacaacaggtttccggtgccctccgaacggccgcagccgcgcgagtcggcgttcaccacgacgaagccctgcgccgtccaccaggcgggatcgggcgcttcccaaccggtcagcgccgagaaggtcaccggtcgcggctggcgcagtatccggtactgcgccgaaaaggtccaccggttgccccgccgcttgggcaggttgtccttgccgtacgggtggatgctcaggatgaccggtcgcggccccgcgtccggcttgcgaaagacgttgattcgcaacaccgttgcgtcgcgggtggggacggcgacatcccgttcgacgtgcaggtccgcgggtgggtcggtgacggtgacgggcggtttggcgacgccgcgaatcctgttcagcgcgtagcgcaatgcgccggggcgccgccagggacggtccagcgcggtcatccgagtgggcggcacgccaataccctaggcgctcggcggcgcgcctaccacaggtagggggccagccggtagcgcaccttctgggtgtagtcggggtatccgggtagttcctgcagcagcagcttttcctcgtcgaacatgcgcagcgcgagcagcgcggtgcccgggacgacgaacagcagtccccagtacgagccgagcgccagcgggatgccgatcatcatgatcacgtttccggtgtacatcgggtgacgcacgaatcgatacagcccgctggaaaccactgtctggccggcttccaccgtgactgtcgctgcggcgtaactgttttgaatgaccaccagcatggcgatcccgaggccggtcgccaccagcacgtcgccgagcagcgacagccaggccggcaccgacgaccagccgaaccggtggtcgagcgcgctgaacaccatcgccgcgaacaggcccaggaacgagcccgtgatgatgaacttctgcgcggtccggggttcggcccgcgggcccgcgcgcatgcggcgctgcagggccgcggggttggtgcgggccaggtaggcggcgggcacgatggtcgccaccgtgaacaccgcgatgaaaacccaggcctgccagtagtgcagcgtgccggccggcaacaacaggatcaagatccaggagagaattccccagacggacgtcgccgtcacccggagtccggttttcatcacgctctcctagcaacgtaggtcgcggcgccgaaaagccatggcaccgagaatggtcaaccctatgtctatggccagtagccataacaggggtacggcggtgaaatctgcgccgactctgggaatgtgggcgaacggttccaggtggagcagccactgggagaacccggccagcgacccgatcagatacagggcgacgaagccgatcagcacgccccaggccaccggggcgaaccgcggcgcgacgccgaagacgcagaccgtcaccgccgacagcagccagaccgcgggcagctggacggccgcgctggccaccaccatggccagcttgccgccgacatcaccggccgcgatgccgtagaccaggccggcgactgttccgctggccagcatcgccaccccggacccggccagcgcgatcaccaaatgacttgccagccaacgggttcgcgacaccgcaccggccaacaccgtttcggcgcgttggctcgattcctcctggtgcaaccgcagggtgagcgagacggcgaacgtggcggcgaccatgcccatcatggcgaacgccacggcgatgaacgcgtcctcgagagcgctggtgccgcccatccgcgcgacgatgtcgcgcgcctgtccgctgtcgcccagctcgtcgccgatgccgtgcaccacgctgccgatcagcaggccgtacagggccagtcccgccgtccacaacagcagcgcggcgcggtccagccgccacgccagcccgaaggcgttgcccaaccgcggcgcggcggtggccgggccggggcgctcggcgatcagcccggcgccgacgtcgcggccggcgagcagccggtaggccagcacggtcaggccggccgtggtcaccaggtgcagcaccagcacccaccagcgatcgcccgcatacggtttcaccagcagcgaccagcccagcggggacagccaggacaggccgcccgggccggcgtcgccgacggcacgcacggtgaaggcggtgcccaggacggcgaacgcggcgccgcgcgcgaaccgggcgctgggcgacagctgcgcggtgaccgcggccaccgcggtgaacaccaggcccgaccaggccaaggccgcgccgaaggccagcgacccgccggccgggacgtcggtgcccagcagtcccgccgcgccgatcgcgccggtggcgatcgaggcggcgaacgacagcgtcagcgccgcggtcaggccggcgtagcggccgatcgcggtggagtccaccagctcggtgcgcccgttttcctcgtccgcgcgggtgtgccggatcaccgtgaggatcaccgcgacggcgatcagcacgtgaaacattccggctttccaaatccccacggccccaaggctgtcgctgtacacctggccgtacagggcgcgctgggccgggctggccatgatggaggcggcgaaaccggcccgcgcggcggcggtggggtagaccttctcgatgctgccgacgtagaccgtggacaacggcaccgacagcagtaacacccacagcggcaacgagattcggtcccggcgcaggtagagccgcagcatctgcagcgtgccggagaagtgcgaaccgcctagcggcgcgggcgaggccgatgcggagggccggttcagggttgtcgcgctcatgacagcgacacctcggcctcgtgggctcggcgctggccgtcggtcccggaggtgtcgtagtggcgcaggaagagctcttcgagggtcgggggctggctgaccagactgcgcaccctggcatccccgagcacccggatgagctcaccgaggctttcgctgtcgacctgcgcgcgcagcgtgttgccctcgatgctgatgtcctcgacgcccttgatccgcctgagatcaccggggtcaccggtcatttcggccttgatcgaggtgcggctcagatgccgcatcgagctcagcgaaccgctttcgatggtcttgccggcccggatgatcgtcacccgttcgcacaacgcctccgtctcggccaggatgtggctggacagcagcaccgtggtgccccggtcgcgggcctgcgccacgcactgttgaaaaacgttctccatcgacgggtccaggccgctgctgggctcgtccaagagcagcagccgggcgcgcgacgagaacgccgaaatcagcgaaaccttctgccggttgcccttggagtaggtgcgtgccttcttgtgcgggtcgaggtcgaagcgctcgatcagctcggcgcggcgcttcttgtcgatgccgccgcgcatccgggccagcaggtcgatgatctcgccgccggtcagtgacggccacagcgtgacatcgcctggaacataagcgatttggcgatgcagttcgacggcctgggtccacgggtcgccgcccagcagccgcaccgtgccgccgtcggctttcaccagtcccagcaggatgcggatcgtggtcgacttgccggcgccgttgggccccaggaaaccgtggacttctccctcccgcacggtgaggtcgagaccgtccagtgcccgcaccgcaccgaagttcttggtgagcccgcggatctcgatgggcgcaaaaccgtcagttgccatggggaatctccttgatcttcggcagccagaaatgcgtcgtacatggtgcggtccgccatcaggccctcggtgtagatctcgagggcgggcaggatcatgtcgcgcgaatagtcgcgcaacaccgcacgcaaatcggttgggttgtcatgcatttgcagatagagcagcagtccgccgcctccggtgatcccgagatatttggccctggcccggggatcgcgactgggtttgatcgtcccggcccgcacgccttcttccaggtatccctcggcgttctcgatcatctggcgccacagcatcttcgccaggtcgccgccggtctgcatgctgcgcagcacgtaggcgatcagcggtgcgaattcctcgatttcggccaattgcccgaaccagacggccgggtcgttggtctgcagcgcctcggtcttgctctcgcggatctgctcggcgatgtggtcgtcgcacgccttgcgcaggccctccttggagccgaagtggtggatcaccagcgcggcgctcaccccggccgcctcggcgatccggcgcagcccgacgccgaacccgtgttcgccgaattgctcgatggccgcgtcccggatccgggcggcggcggtgaggtcggctgaacgcatgttcagcacgctaaacgtatgttcagcccgcggtcaaggggggcgcgcgtcaagaatcggtaaaaatgcggccggcccggcagaggcccgccaaggcccggcagaggcccggcaaaggccccgaaaggccccgccgacggcccggcaagggcgcgacgggcccgaggtgccgtgtcagtcgcgcaccgcggccagaatgccgtcgccgagcggcaccagcgccggcgtcagccgctcgtcctcggcgatcagccgcgccgcctcgcgcaccgccaccacctcggcgtcgcgggcggccgggtcgccggcgcgcccgcccagcgcggcccggtgaaccacgatcacgccgccgggccgaagcagccgcaccccctcgaccacgtagtccggctggtcgatcgggtcggcgtcgatgaacaccaggtcataatactcgtcggcgagccgggtgagcacctcctgggcgcggccgccgatcagccgggtgcgcgacggcccgatgccggcctcggcgaacgcctgcttggccagccgcaggtactccggctcgatgtcgatcgtggtcaggacgccgtcgtcgctcatgcccgacagcaaccacagcccgctgacgcccgcgccggtgcccacctcggcgatcgccttgccgccgctcagcttggtcagcaggctcaacaacgcgccgaccgccggcgtcaccgcgcccgccccgatgtcgacggcccgctcgcgggcggccgccaacagcgcgtcttcggagatcgaggcctcggcatgggcgaccagcgattcggcccgactgggcgctgtttggccgggggcttctgcgtcggtgccgtccatgcccgcagcgtattccaattcaccgcgcagtccgacaggcgcgcctgaacccgatcccgccgacacgcccgaccggcgcgccgcgtttaaggtcaccgggcgatggatgtctcctgcacagcgcaggtaacgaaaaggtttctcaggctcagctcagattgttcatataccgcacatacgccgatacgcgacggtgtccgtatggatcgcggagcgcgggagaccgggaataccgaatggcagctgcctgttgccgccaatgacgaaatgccgctgatcggcatgccgaattcggaggaattgatcatcaccacgcttttgagcccgtccagcatgtcgcacgcgcacgacccttccgccgacgggtgggcggagccgtccgacgggctgcagggcaccgcggtcttcgacgcgaccggtgacaagacggccatgccgtcgtgggacgagctggtgcgccagcacgccgaccgggtgtaccggctggcctaccggctttccggcaatcagcacgacgccgaggacctcacccaggagaccttcatccgggtgttccggtcggtgcagaactaccagccgggaaccttcgagggctggctgcaccgcatcaccacgaacctgttcctggacatggtccgccggcgctcgcgcatccggatggaggcgctgcccgaggactacgagcgggtgcccgccgacgagcccaatcccgaagagatctaccacgattcgcggctcggccccgacctgcaggccgcgctggactcgctgccgccggagttccgcgccgcggtcgtgctgtgcgacatcgagggcctgtcgtatgaggagatcggcgcgacgctgggggtgaagctgggcaccgtgcgcagccgcatccaccgcggccgccaggccctgcgcgattacctggccgcgcaccccgaccacgacgcgctgcgcgcctcctcggcgtagtcagcgcccgcccggctaacgttcgggcagctattcagcggctttgcggccttggcgtcggtatcgggcgccgtgtcgcgctacattcgaagaaggcgaataaggcggcaataagaatgaatggcaaggagctggcgatgcccgatcgaggacatgtgttccgccgcgcgttctcctggctgcccgcacagttcgcctcccagagcgacgcgccggtgggcgcgccccgccagttcggctccaccgagcacctgtccgtcgaggccatcgccgcgttcgtcgacggcgagctgcggatgaacgcgcacctgcgggccgcgcatcacctctcccagtgcgcacagtgcgccgccgaggtcgacgaccagagccgggcgcgcgccgcgctgcgcgactcgcgcccgatccggatccccgccaacctgctcgggatgctggccgagatcccctacgagtcgcccgacacccccgaccgtttggcggaccgcgacgcccgcgaccggcgccggcgtccgtagcgtcgtgccgtcccgcgcgttcccgcggccaccggtgcgccgtggatactagggtggacacggacaacgccggtgccgcgtaaatcgcccggtaaaggcctgtctcgagcgctcaaatcgaggatccaaaagggataacgtgacctccgacccaggctacgaccaagcaaaagacagcgccaaccggttggcgccgcgccccatctcgcgcccgcccgtcgaccccgcatcgcgccgggagttcggccggcccgccgggctgcggggatcgttcgtggccgaacgcgtgcgtccgaagaaataccgcgagcagtcggagttccggccgagcgagcagccggccgaccccgtgctgcaggaggcgttcagccggcccgacggcagcccggagacgctgcagcgccaccccgtcgacagcggcgcgctggcggccgagaaggacggggtggagcccgaccacgccgacgacccgtggcgtgacccgggggccccggccgcgttgggcacgccggcggtggcgccgtcgccgtcgcggtccgcgctgggctacggcggcaagctgggtgtgcgcgacgtgctcttcggcggcaaggtgtcctacctggcgttgctggttctgctgctgatcgcgctggtcatcggcctgatcggcggtgtggtcggccgcaagaccgccgaggtcgccgaggccttcaccacgtcgaaggtgacgctgtcgacgaacggcaacggcgaagccccggccgggcgtttcgcgaaggtggcggcggccaccgcgggcgcggtggtcaccatcgagtccaagagcgaccaggagggcatgcagggctcgggcgtcgtcatcgacggccgcggctacatcgtcaccaacaaccacgtcatctccgaggcggcgaacaaccccagccagttcaagaccaccgtggtgttcaacgacggcaaggaggtgcccgccaacctggtcggccgcgaccccaagaccgacctggccgtgctgaaggtggacaacgtcgacaatctgtcggtggcccggctcggtgactccgacaaggtgcgggtcggcgacgaggtgctggccgcgggcgcgccgctggggctgcgcagcaccgtgacgcacggcatcgtcagcgccctgcaccggccggtcccgctgtccggggagggctcggacaccgacacggtgatcgacgccgtgcagaccgacgcgtcgatcaaccacggcaactccggcggcccgttgatcgacatgaattcccaggtgatcggcatcgacaccgcgggtaagtcgttgtccgacagcgcaagtgggctgggcttcgcgatccccatcaacgaggccaaggaggtcgcccagaccttgatcagggacggcaagatcgtgcacccgacgctgggggtcagcacccgctcggtgagcaacgcgatcgcctccggcgcgcaggtggccaacgtgaaggcgggcagccccgcgcagaagggcggcgtcctggagaacgacgtcgtggtcaaggtgggcaaccgcaaggtcgccgacgccgacgagttcgtggtcgcggtgcggcagctgaccatcggccaggattccccgatcgaggtggtgcgcgacggccgccacgtcaccctgacggtgaagccggacccggacggcagctgatgctcggcagtctgagctgggagcacatgctggtcctcgtggtggtgggcctggtggtgctcgggccggagcggctgccgggcgccatccggtggacgtcgaacgccctgcgccaggcgcgggactacctcagcggtgtgaccacccagttgcgcgaggacctcgggcccgagttcgacgatctgcgcgtcccgctcagcgagctgcagaagctgcgggggatgacgccgcgggccgcgctgaccaagcacctgttggacggcgacgattcgttcttgaccggggccttcgaccggccggtcaacggcgccgcggcccagccgccgcccgccccggcgccaccgcccgagccgcaccgctccggccagacgccgttcgacgccgacgccacctgaaccgtcagcgccgggtggggtcgagccccagcgacaccccggccagtccgcgccggcgcgacgacaggctgtcggccaccgcgcgcagcgccttgcccaccggcgaatccggcgcgctgagcaccagcggggtaccggaatcgcccgcctccaccagcgcggggtccagcgggatctgacccagcagcggcacctcggcgccgaccgcccgggacagccgctcggccacctgctggccgccgccctcgccgaacacctgcaacgtggagccgtccggcagggtgagccccgacatgttctccaccacaccgaccacccgctggcgggtctgcagcgcgatgctgccggcccgctcggccacctcggcggcggccagctgcggcgtcgtcaccaccaggatctcggcgttgggaatcagctgggccaccgaaatggcgatgtcaccggtgcccggcggcaggtcgagcagcagcacgtccaggtcgccccagtagacgtcggccaggaactgctgcagcgcccggtgcagcatcgggccgcgccacacgaccggggtgtttccctgggtgaactgggcgatcgagatgacccgcacgtcgtgggcgatgggcggcaggatcatcgactcgacctgggtgggccggtcggtggtgcccatcatccgcgggatggaatggccgtggatgtcggcgtccagcacgccgaccgacaggccgcgggcggccatcgccgccgccaggttgacggtgacggtggactttcccaccccgcccttgccggacgcgaccgcgtagacccgggtcagcgaattcggttgcgcgaacgggataaccggctcgcgggcatcgccgcgcagctgcttgcgcagctcggtgcgctgctcgtcgctcatcacgtccagggtgaccttgaccgcgccggtgcccgggacgtcggcgaccgcccgggtgacccggtcgctgatctcggtcttcttcgggcacgcggccgtggtcaggtagatcgcgacatgcaccgcgccgtcgggctcggtgtcgatgctcttgaccatcccgagttcggtgatcggacgccgcagttcggggtcgatcaccttgcccagggcggcgcggacggcggcgctcaggtcggctgctgagtcggaggagtcatggcgggacatcaccgccgagtgtaggcgggtggccgggtgccgtcgggcggcgaccctgcgggccggctagaccgggcccggcttcttcggcgcgttcggcgcggggccggccgccgcgggcgacggcgcttgcggtgcgggtccggccgggggcgacggcgcggcttgcggtgccactccggccgggggcgcggggaccggcccggcatccgggggcggcggcccgaacggtggcggcccggacggcggcggcgcgaacggcggcggcccggacggcggcggcgcgaacggcggcggggcgccgaacgggggcgggccggccggcggggagccctgcgagctgatgcagatcaccgtgcacccgggaacctgggtcggtgcctgctgcggggtgggcgtcatccacgggaacatcggctgcgggctgccgagcgcggggctgctcaggtcgatcagcggcacccgggccagcgggtcgtccagcggcaggccgttgatgttcatcggcaggttgggcccgagcccttcggggtgctcgaggtgcgcatcgcccagcggcggcggcggcccggtcatcggcggcaggtcgaccgggacgacgccggtcgcataggccgccgcccagcccagcacgttctgcgcgtagggcatcgagttgttgtagcgcaggatcgcggtcagcacctgcgactggtcgcgcaggttgagcccgccgctgcacaggtagcgggcggccgccagggtggagtcgaacaggttctgcgggtcggccacgccgtcgcccttgccgtcggaggcgtagcgcgcccaggtgcccggcaggaactgcatcggccccatggcgcgcgcgtaggtgacccggttgccggcggcgctctggatgatgacctcgttgccgggcagggtgccgtccagcgacgggccgtagatcggggtgatcgcggtgccgcgcgcgtcgaccgcgccgccgcccgcgtggcccgattcgatgcgcccgatcccggccagcaggttccagctcacgccgcagcccggggcggcgacggccatcttctgctccgcattgcggtaggcggccagcgcgatactcggaatgccaagcgccccaggcgcattgacgatcgcggccggcggcggggcggacagtgccggctcggcgacgtgaaaggcggtggggccgcggtcgatcgcgacgacggcgggaccggcgaggtcggggaaggtcggcgagacggcggccaccggggtgacggcggcgtgcaccgggggcgttcgcaccggcagcgacgggcccgtcgcactgaccgcacccgcgaagaccaagggagtgatcatggcgatgccgaatatcggcttgcgcgtgttccgaagtgctcgctgccgcacagtcgcggcggccgggtctgcaccccggcttccccctatgcgcactcgaccgtcctaggtgtgagctgggcgttactttctgttagctcggtgaaccagatcaccatacataactcttgtgacgcgagtggcgcaatggtttgaccggttctcacctggatttcttagccgtctgctcccggttgtcggcgtcggaaaccggctcgccgtcggcgctttggggccgcagctctgcgagcagttcacgcaggtcgtcgagctcgtggcgcaggtactcccgcgtcaccacctcgccgacggccagccgcaccgcggccagctcgcgggccaggtactcggtgtcggccttggtctgggcggcgcgacggcggtcctcttcgagcgccacccggtcgcggttctcctgccggttctgcgccaacaggatcagcggcgccgcgtaggcggcctgggtggagaacgccaggttcagcaggatgaacggatagggatcccagcgcagtcgcaccgcgaacacgttcaccacgatccacaccgccaccacgatggtctgcagcagcaggtaccggccggtgccgaagaagcgcgcgatcgactcggtgatctgcccgacggtctcgggatccagccgcggcgagtaccggcgcgatgtccgcggcgtgtacagccggcgcacagccgtggatttgctcacccggatcctcccagtccctcgagccggccggcggtgtcgagttcctgcatgtccacccgccagtccggcggcagcaggtgatcgagcaggtcgtccacggtcaccgcgcccagcaggtggttctcgtcgtcgaccacggggccgcacaccaggttgtatgcggccaggtagcgggtcaccgcgaccagcggcgtctccggccgcagcgtcagcaggtcgctgtcgacgatcccgccgaccagctcggccggcgcctcgcgcagcagccgctgcaacggcacacagcccaggtagcggccggtgggggtggccgtgggcgggcgcaccacgaacaccatggacgacagcgcggcggtcagatcgggatcgcgggcccgggccagcgcctcggcgaccgcggtgtccggggtgagcaccaccgggttggacgtcatcaggccgcccgcggtgtcgggggagtgggtgagtaggcggcgcaccgaggccgaatcgccggggtccatccgtttcagcagcatctcggcgtcggtcggattgagcaccccgagcaggtcggcggcgtcgtcgggatccatctcctcgagcacgtcggccgaccgttcggtccccagctgcgagagcacctcggcctggtcgagttcgggcagctcctgcaggatgtcggccagccggtcgtcgttgagcgccttgagcacctcgtagcggcgcttgggcgggagtccgcggatggcgtcggcgacgtcgaccggcttgcggccctcgaactgttcgagcagctgcgcgacggcctggccgggcagcgccagcgccgacggggtcaggccctgcacgttgcgccagtccaccacgtgcaccgggccgcgccggcgcagccgtcgctgcgggcgcaccgcgacccgggtgaccatccagtcccgcgtccgggtctgctcgatgcccaggtcggtcaccaccacgtcgacaccggccagctccggcagttcggggtcgttgaccttgaccacggtgtcgagcacctgacctatggccagcacctcgccgggccgctgctcgaaatggcgcagcgacacgctgccggtgctcagcgtcacggcgttggggtcgatggcggccacccgcaggatcgggatgaagatgctgcgccgcgtcgccaggtcgacgaccagccccagcacccgcggttgctggcggacgatgctgatgctgatcaccacgtcgcggacccggccgacggattcgccgagcgggcccagcaccagtatccgcgccagccgcgcgatgtacaccctgttgaccgatcccatggcagtagagcctaggcagccgccggttcgatggccgagcgcacctagtgggtgtgcaaggcgaacagcacgaccaccaaagtcaccaccagggtggcgattccgatgacgatgccggcgacggccaggccgaagccgtcctggcgggtccgcttgatctggtccagggcgatcgcccccagcacgatggccacgaccgagccgatgccgcacagcaggccggtgaacgacgcgatcagcgaggcgatcgccaaaccgttggtcccgggctgcccgccgagcagcggcggctggggcgggtagccaccgtaatccggaccggggtagtagccacccgggtatccgggcggtccgtagcccggcgggggcggcggcccgtacccgggcgggggcggcggaacaggggacggagccggcggcgggtacgggggcggatagccgggtgggtagtcggccggatagcccggcggtgggtagggcgggggtgcggagccggcgggcggttcccacggggccggctgggtgtgcggcgccgaggttgcgtcgtcgttgggcttgtcgccgtgggtctggtcgccgtggtggtcgccgtggtggtcgtgttgggcgctctcgccgaagccgccgccgggagccgtcatggtgttcaacctaacccatccgcgaccggcggctgcggcgccgaagcccggcgcgcggcgcgcggtgtttccgcaggtggcatccgttggccggctggaccggctggataggctggggaggacctgagatgaaacgacggtcgaggcggaggagaatgagcggcgatgactagtcctttccagcccgggcaggttcccggcgcgccaccccccggcgcgggcggtcgccgcggcgtgcccggtctgccgacaccgccccggggctggcccgtcggctcctatcccacctacgccgaggcgcagcgtgccgtcgactacctgtccgaccagcagttcccggtccagcaggtcaccatcgtcggggtcgacctgatgcaggtggaacgggtgaccggccggctgacctggcccaaggtgctcggcggtggcgtgctgagcggggcatggctgggtttgttcatcgggctggtgctcggattcttcagccccaacccgtggggggcgctggccaccggtctggtcgccggtgtgttcttcgggttgatcacctccgccgttccttactcgatggcccgtggcacaagggatttcagctcgaccatgcagctggtggcgggccgctacgacgtgctctgcgatccgcagaatgcggagaaggcgcgggacctgttggcgcgcttggcgatttgaggcgcgcacgagaggtgtgaacaagtggtgatcggtcgtgggcgcgtacgccgggcaggcgcggtcgcgctggcgacactcaccatcgccgcggcgtcgtcggcatgcgtcgccgggccgcgcgggctggtgatcagcttctacaccacggccaccgacggcgccacgttcgccgcgatcgcccaggattgcaccaggcagttcggcggccgcttcgccatccaacagatcagcctgccccgggccccgggcgagcagcggttgcagctggcccgtcggctgaccggtcgcgaccgcacgctggacatcatgtcgctggacgtggtgtggaccgcggagttcgccgaggcgggctgggcgctgccgttgtccgacgaccccgcgggccgcgccgaagccgacgcgaccgtggacaccctgcccggcccgctgtccaccgcgcgctggcacgacaggctgttcgccgcgcccgtcacgacgaacacccaattgttgtggtaccggccggatttggtgcttcagccgccgcggacctgggacgccgtggtgaccgaggcggcccggctgcacgccgcgggccggcccagctggatcgcggtgcaggccaacgagggcgaaggcctggtggtctggttcaacacgttgctggccagcggcggcgggcgggtgctctccgaggacggccgccgcgtcacgctgaccgacaccccggcgcaccgggcggccaccgtcaacgcgctgcgcatcctcaagtcggtggcgaccgcccccggcgccgatccctcgatcacccgcaccgacgagggcaccgcgcggctggccgtcgaacagggccgcgccgccctggccgtcaactggccctacgcgctggcctcgatgctggacaacgcggtgaagggcggcgtgcccttcctgccgctgaaccgggacccgaggttggccggcagcatcaacgacgtcggcatcttcgtgcccaccgacgagcaataccgcatcgcctaccaggccagccagaaggtcttcgacttcgcgccgtatcccggtgcggcgccgggccttccggccaaggtgaccatcggcggggccaacctggcggtggccagcaccacccgccaccgggccgaggcgttcgaagccatccgctgcgtgcgcagcctgcagcatcagaagtatgtggcgatccagggcggcctgccgccggtgcgcacctcgctgtactccgacccgcagttccagaccaagtacccgatgtacaccatcatccgccgccagctcaccgacgccgcggtgcgaccggccacgcccgtctatcagacggtgtccatccggctagccgcgacgctgagcccgatcaccgggatcgacccggagcgcaccgccgaccagctcagcgtcgaggtgcaaaaggccgtcgacgggaaggggctgctgccgtgacggccaccctcggcgaaacacgccctaccccaacgtcttccgccgcgccgagcgtgctgggccggacatccgaacagcggctggcgcttgtgctggttgcgccggcggcgattctgatgctggcggtgacggcctacccgatcggctatgcggtgtggttgagcttgcagcgcaacaaccttgcggctccgcacgacaccgcgttcgtcggcctgagcaattacgcgaccatcctcagcgaccggtattggtggaccgcgctggcggtgacgctgggcatcaccgtggtctcggtgtccgccgaattcgtgctgggcctggcgctggcgctggtgatgcaccgcaccctgatcggcaagggcctggtgcgcaccgcggtgctgatcccgtacggcatcgtcaccgcggtcgcgtcctacagctggtactacgcctggacgcccgggaccggctatctggccaacctgctgccgcacggcagcgccccgctgaccgcccagatcccgtcgctggcaatcgtcgtgctcgccgaggtctggaagacgacgccgttcatgtcgctgctgctgctggccggtctggcgctggtgcccgaggacctgctcaaggcggcccaggtggacggcgccggcgcctggcggcggctgacccgcgtcaccctgccgatcatcaagccggcggtggtggtcgcgctgttgttccgaaccctggacgccttccgaattttcgacaacatctacgttttgaccaacggcgccaacaacaccggttcggtgtcgatgctgggctacgacaacctgttcaagggtttcaacgtggggctgggctcggcgatcagcgtactgatcttcggatgcgtgggcctgatcgcgctggttttcgtcaaggtcttcggtgcggcagcacccggtggtgacgtcgatggccgttaaccgaaccgccgcgcgtcgcacagtgctctgggccgtgatcgacacgctggtggtggtgtatgcgctgcttccggtgttgtggatcttcagcctgtcgctgaagccgacgtcaacggtcaaggacggcaagctgattccgtcggcgatatcgctggaaaactatcgcggcatcttccgcggcgacttcttcagctcggcgctgatcaactccgtcgggatcgggctgatcaccaccgcggtcgcggtgctgctcggcgccatggccgcctacgccgtggcccggctggactttcccggcaagcggctgctgatcggggccaccctgctgatcaccatgttcccggcgatctcgctggtcacgccgctgttcaacatcgaacgcttcctcggcctgttcgacacctggccggggttgatcctgccgtacatcacctttgcgctgccgctggcgatctacaccttgtcggcgttcttccgggagatcccatgggatttggagaaggcggcgaaaatcgacggcgccacgccggcgcaggcgttccggaaggtgatcgtgccgctggcggcgccgggcgtggtgaccgcggcgatcctggtgttcatcttcgcctggaacgatctgctgctggcgctgaccctgaccgccaccaaggcggccatcaccgcgccggtggcgatcgtgagcttcagcggcagttcacagttcgaggagccgaccggatcgatcgcggccggggccgtggtgatcaccgtccccatcatcttgtttgttctaatcttccaacgacggatcgtcgccgggctgacctctggcgctgtgaagggatgactcgatggccgagattgtgctggaccatgtcagcaagagctacccggacggcgcgacggcggtgcgcgacctcaacctcaccatcgccgacggcgaattcctgatcctggtcggcccgtccggctgcggcaagaccacgaccttgaatatgattgccgggcttgaagatatctcatccggcgagctgcgcatcggcggcgaacgggtgaacgagaaggcgcccaaggaccgcgatatcgccatggtgttccagtcctatgcgctgtacccgcacatgacggtgcgccaaaacatcgcgtttccgttgacactggccaagatgaagaagcccgagatcgcccagaaggtcgccgagacggccaaaatccttgacctgaccgactttctggaccgcaagccgtcgcagctgtccggcgggcagcggcagcgggtggcgatgggccgggccatcgtgcggcacccgaaggcgttcctgatggacgagccgctgtccaacctggacgccaaactgcgggtgcagatgcgcggcgagatcgcccggctgcagaagcggctgggcaccaccacggtctacgtcacccacgaccagaccgaggccatgaccctgggtgaccgcgtggtggtgatgcattccggtgtggcacaacagatcggcacccccgacgagctgtacgagaacccggccaacctgttcgtcgccggcttcatcggctcgccggcgatgaatttcttccccgccacgctgacgccgatcgggctgaagctgcccttcggcgaggtgatgctgacaccggaagttcaacaggtgatcgccgagcatcccgagccggacaacgtcatcgtcggcgcgcgacccgaacacctgtccgacgccgcgctgatcgacggctaccagcggatcagggcgctgaccttcgaggtaaaggtcgacatggtcgagtcgctgggcgccgacaagtacgtgtacttctccaccgcggcgtgggccgcgcactcgacccagttggacgaactggccgccgaggcggatgcacacgaaaaccagttcgtggcaagggttcccgccgaatccaaagcggccatcggccagacggtcgagttggcgctggacacgacgaagctgatggtcttcgacgccgactccggggtgaacctgaccgtcgcgccgtccggctcgccgtgagccaggccctggagccggtgcgcgcgcacgtgcgggcgcacttcggcggccacgaacccgattcggccagcgtgacattcctgggtaccgaaaccatcgaggtgctgcggttccgcacggccgacgggctggtgcactacgtctcgctgggctgctcgcgtcatccgatgaccgaaccgacggccgagatcgccgacccggtgcgcggaccgcgcgccgagatcgtgctgcggctacgcgatcccggccccgtcaccggcatcgcaaggagcctggcgatcctggcggcatccccggccgtcgagggcgcggtgctggtcgccggcgcgctgatcgacctgggctcgccgctgtgggcgtcgccgtcggcccgggtgccgttcacggcagtgctgttgggccgcagcgatattcccgatctgccgctgccgccgccgcgcgacccggtgcaattcctgtcggcgacccccatcaccgccacggaagcggcgtgggtgcggctgaagggcgcggaggcgatgcggcaggcgtgggacaacgacggcgtcgacgtgctggacccgaatcgccccgccgcccagccggattgacccccgccgtttcccgcgagcagacgcaaaagcccccgacacgccgggcgtcgaggggcttttgcgtctgctcgcgggggaactcgcgggaaatgacaccggcgctcaaccggcgacgcgcggcgcggccagatggccgttgatccgcgcaatgaggccgacggggtcgtgtgccggccaggcgaagtcggcacgccaccgtcggccgtgccggtcggtgatgctgtactgcagctccggcatcggcagcccactgccgatgaacagcagtcgtgcctcactctccatgggcgattcggcgcggccgtcggcgtaggccagcaattcccggaccttgacgattccgcgacgaccatgctgctcgcgagccgccgcgtccagctccgctgcggtgcatgcgccgacacgcagtgccgcatcaagcgtggccagggcacgcgcgggccgcagcgcgcgggctacttctatcgcggtccacgccggcatcgtcgccagatggcccttcactcgtcgcagcggcgccccaatccgttggtgcaccatgattttcggtgacgggcgcatccggattcccggatcgaggacatggattctggtggtgcgctcggtgtcgaagccgtacagcgcggcagcggtgcccatgcacgcgaccaccggccgtccgaccctcagttgcgcggcgtccagcgcatcggacacgtcgggaacgttgggtgcgtataccccgtgacagacgcggatgagcatgccggacttgaccagaccggccaattgtttgcgcgagaccgcggtcagcagttgggaagtggttgccagcccgtcgccgcgcaggatgaggctctcgatgtccacagccgcagacaatgcggcaaggcaagtgtcggaaccagccagctgccgcggcgatgtggataagtcccccaccccctccctcgagcagacgcaaaagcccccgacacgccgggcgtcgaggggcttttgcgtctgctcgcggaggaactcgcgggaaaagcgagcgctagagccagttgcggttgcggaactggaagtacagcaccaggcagacgacggccatgcccgccatcaccgccgggtatccccaggtccagttgagctcgggcatgaaatggaagttcatcccgtaaatggcggcgatcatggtcggcaccgccaagatgccggcccaggccgccatcttgcgcatgtcgttgttctgctgcatccccacccgggccagggccgcctggatcagcgagttgagcatgtcgtcgtagctggcgatctggtcggcggcctcggagtggtgatcggcgacgtcgcgcagatagcggcgcacctccttggagatcacgtccttgttctcggtctggatccggtgaaacgccgacgacagcgggttgacgcagcggcgcagttcgacgacctcgcgcttgagcagatagatcggttcgacgtcgatcttgctgcccggggcgaacgccaacccctcgatgctgtcgatgtcggcgagcatcaagctgctcacctcgagatagtggtccaccacgtggtcggcgatcgcgtgcatcaccgcgaacgggcccagccgcatttgctcggggtcgccgtccatccgcttgcgcacctcggacagcccgccgtgttcgccgtgccggacggtcaccacgaaatcgcggccgacgaacaccatgatctcgccggtctcgacgatctcgcgggccagcaccaccgattcgtgcggcacgtagttgacggtcttgagcaccagaaacagtgtgtcgtcgtagcgctccaccttgggccgctgatgggcgcacacggcgtcctcgacggccagcgcgtgcagcccgaaaacgtctgccacttcctgcatttcggtctggttcggttcgcgcaggccgacccagacgaatccctcgcgcccctgggattcgatctcgcggaccttgtccagggcgtcggcgtaaccgaacacgccgggcagccggttcccgtcgtcgtacaccgcgcagtcgaccagcgtcgcgcgggccggcggggcctcgggcgccggctgcgggtgcggttggtgggcgatgggccgaagcacttcgggcaatgcgtcgaatccctggaacacatccacctcccacgcagcgcaggtcagaccaggcggtgctcatgctacgcgtcccggcgccggccggcgtgacgatcgcgcggcggaaagccctggtagcggaccggagatcggcggcaaagaagggtgcgctagtttcgagcggaacccgaatctgcacgaacttctccacacaaggggtacatcgacgtgagcgcaagtcctctcaaggttgccgtcaccggcgccgccggccagatcggctacagcctgttgttccgcctggccagcggctcgttgctgggccccgaccgcccgatcgagctgcgtctgctcgagatcgagcccgcgctcaaggcgctcgagggcgtcgtgatggaactcgacgactgcgccttcccgctgctgtccggcgtcgagatcggcgccgacccgaacaagatcttcgacggcgccaacctcgcgctgctggtcggcgcgcggccgcgcggcccgggcatggagcgcagcgacctgctggaggccaacggcgcgatcttcaccgcgcagggcaaggcgctcaacgaggtggccgccgacgacatccgcgtcggcgtgaccggcaacccggccaacaccaacgcgttgatcgcgatgagcaacgccccggacatcccgcgcgagcggttctcggcgctgacccgcctggaccacaaccgggccatctcgcagctggccaaaaagaccggcgccaaggtcaccgacatcaagaagatgacgatctggggcaaccactccgccacccagtaccccgatatcttccacgccgaggtcaagggtaagaacgcggccgaggtggtgggcgaccagaactggatcgagaacgacttcatcccgaccgtggccaagcgcggcgcggccatcatcgacgcgcggggcgcctcctcggccgcgtcggccgcctcggcgaccaccgacgccgcccgcgactggctgctgggcaccccggcgggcgactgggtctccatggccgtcatctccgacggctcctacggcgtgccggaggggctgatctcgtcgttcccggtgaccaccaaggacggcgactggaccatcgtgcagggcctggagatcgacgagttctcccgcagccggatcgacaagaccaccgccgagctcgccgacgagcgcaacgcggtgacccagctcggcctgatctaagaccgacgtgggcaattaggactacttatgggtagcccttaccctgaagcgcgtgtccgaattgcttgaatcgatacagagtcgcgccgagcagggcgcgatcacggacgccgagatcttcgcggcacacgtcggcggcaagctgtcggtcagcctgacctccccgctggacacccagcgcgcgctgtcgatcgcctacaccccgggcgtggcgcaggtcagccgggcgatcgccgccgaccaccgtcaagcggcgcactacacctgggccaaccggctggtggccgtggtcagcgacggcagcgcggtgctcggcctgggcgacatcggtcccgcggcgtcgctgccggtgatggagggcaagtgcgccctgttccaggcgtacggcgggctgaacgccatcccgatcgtgctggataccaaggatcccgacgagatcgtggagaccctggtgcggctgcgccccaccttcggcgccgtcaacctcgaggacatctccgcgccgcgctgcttcgagatcgaacgccgactcatcgaggcgctggactgcccggtgatgcacgacgaccagcacggcaccgcgatcgtcgtgctggccgccctgatgggggccagcaagctgctgggccgggacatgagctcgctgaaggtggtggtgtccggagccggggcggccggcgtcgcgtgcaccaatctccttatggcgatgggtgtttcggacatcaccgtgctcgactcgcggggaatcctgcacgccggccgcgacgacatgaacgacgtcaaggcggcgttgtcgcggcgcaccaacccggccggcctgaccggcagcctggccgaggcgatccgcggcgccgacgtgttcctggggctgtcggggggtgtggtgcccgaggagatgatcgcggccatggcgcccaatgggatcgtgttcgcgctgtccaaccccgacccggagatccatccgcagatcgcggcgaagtacgccaccgtggtggccaccgggcgcagcgatttccccaaccagatcaacaacgtgctggcgttccccggggtgttccgcggcgcgctggaggccggcgcccgccggatcaccgagaagatgatggtcgccgcggccgaggcgatcttctccgtcgtcagcgacgacctcgcgcccgatcggatcgtgcccagcccgctggacacccgggtcggggacgcggtcgccaccgcggtggcgctggccacagaagtttccgacgctcccgccgggtgagaatcggcaggctggtcgcgccgctgctgaccgccctacttgccgtcaccggctgcacgaccgacaccggcgaccgtcgcgcccacgccgaggtggtggtgggctcgcggcccgacgcctcctcgacgctgctggccggcatctacgtcgccgcgctgcggtcctacggtttcgccgcgcggcccgcgacggccggcgacccgacagcccaactggattcgggcgccttcaccgtcgtccccgccttcaccggacgggtgttgcagtcgttgcagcccggcgcgacggccatgtcggacaaggacgtgtaccgcgcgatgatcgccgccctgcccgagggcatcgtggccggcgactacacgacggccgccgaggacaagcccgtgttgctggtgagccgcgccaccgcccaggcgtggggcggcagcgacgtcagcgcggacctgagcacgttgccgcggcactgcgacggcctggtcgtcgggaccgtcgccgggcaccccgcgccgccggcggtcggcagctgccggttggccgccccccacgaattcccggatggcgcaacgatgttcgccgcggtgcgggccgggcagctgaccgcgggatggacgacgacggccgatccggggacgcccgccgacctggtggcgctggccgacggcaagcccgcgctgatccgggccgagaacgtggcgccgctgtaccggcgcaacgcgctcagcgagcggcagttgctggcgatcaacgaagtggccggcgtgctggacaccgcggcgctggtcgacatgcgccggcaggtggacaccggcgccgacccgcaggcggtggccggcggctggctggccgaacacccgctcgggcgttaacgcttgggcagcaaccgggtcacgaactccttgacccggcccatcaccggaccggccagcagccgctcgtagttggggccggccgcccgcaccagcaggtccatggccttgacgtcgggtccgaccagcacccgggccttgttgcggcgcaccccgtccaggatgagctgggcggcgcgctgcggcgtcgtcttggcctgctgttcctcgaacaggctggccagctcggcgtggtcgaggccctcgacaccggtggcgttgcgggcgaacgcggttttgatgccgccggggtgcaccgtggtgacccggaccgggtgaccggcgcgcagcatctcttgatgcagcgcctcggtgaagccgcggacggcgaacttggccgacacgtaggccgcctgcccgggcgccgagaacaggccgagcgcgctggagatgttgatcacgtgtccgtcgccggaggcgatcaggtggggcaggaacgccttggtgccgttgaccacgccccagaagtcgacgtcgaccacccgctcgatgtccttgaaccggctgtcctcgatggagccgatgaacgtgatgccggcgttgttgtagatctggttgacccggccgtaatgctcgttgaccgcgtcggcgtaggccaggaacgcctcgcgttcggtcacgtcgagccgatccgccttgaccggcgcgccgatcgcggcaagctgctccgccgtctgcgccagccccgcggtgtccacgtcgctgatcgccagcttggccccggcccggcccagctccaccgccagcgcctgcccgatgcccgatccggcgccggtgaccacggcgaccttgccggcgaacccttgcatgcaacactccctcgagcaggtttgaccgcttgacggtaatcgctgccagcgatgctggctatagggggtctcgtgatcagttgggcagcagccggctcatgaccggcccgaacagccgctggtagcccgaaccggtcagccgcaccaggatgtcgagcgccttggcgtccgagccgaccagcacccgcgccttcttcttgcgcaccgcgtccaggatgatctgggcggcgcgctgcggcgtggtcttggccagccgcttgtcgaacagcttggccagctcggcctggtccaggccctcggccgcggtggcgttgcgggcgatcgcggtcttgatgccgccggggtgcacggtcgtcaccgccaccgggtgaccggccgcggccatctcctggcgcagcgcctcggtgaagccgcgcacggcgaacttggccgagttgtaggccgcctggcccggcaccgagaacaggccgaacacgctggagacgttgacgacgtgtccgtcgccggaggcgatcaggtgcggcaggaacgcctttgtgccgttgaccacgccccagaagtcgacgtccatcacccgttcgatgtccttgaactggctgacctcgacgtcgccggtgaaggcgatgccggcgttgttgtagatctggttgaccttgccgaagtgctccttgaccgcgtcggcgtaggccaggaacgcctcgcgctcggtcacgtcgagccgatcggccttgtactgcgcgccgatcgccttcagctgttcctcggtgtgggccaggccttcgaggtcgacgtcgctgatcgccaccttggcgcccgagcgggccagctcgacggccagcgcctgcccgattcccgatcccgcgccggtgaccacggcgaccttgccggcgaacccctgcatgagcggcctccctcgtgttggttcacgtcgaggctagccggtacccggggtaccgctgtcctcgggtgcgcgcatccacgccgcccgcctcgccgagcgtcacgccagcgtggcgccgggacccgagcgccacgctggcgtgacgctgaggacccgtcgacgcctcaggcgaaggcggtgtcgatgatctcctgctgctcgacggcgtgcaccttcgacgagcccgacgacggcgccgacatcgcccggcgggaaatccgcttgagcccggtcagcttgtcgggcagcagctcgggcagctccaggccgaatcgcggccaggccccctggttggccggctcctcctgcacccagaagtactcgcgcacgttcggatagcggtccagcgtctcgcccagccggcgcttgggcagcggggccagctgttcgatccgcacgatcgccacgtcgtcgcggttgtccttgttcttgcgcgcgaccagctcgtagtagagcttgccgctggtcaacagcacccggctgaccttgccgcgatcgccgatgccgtcctcgtaggtcggctcctcgagcaccgagcggaacttgatctcggtgaagtccttgatgtcgctgaccgcggccttgttgcgcagcatcgacttcggggtgaacacgatcagcggccgcttgatcccgtccagggcgtgccggcgcaacaggtggaagtagttggacggggtggacggcatcgcgatcgtcatcgacccctccgcccacagctgcaggaagcgctcgatgcgcgccgaggtgtggtcggggccctggccctcgtgcccgtgcggcagcaacagcacgacgttggacagctgaccccacttggcctcacccgagctgatgaactcgtcgatgatcgactgcgcgccgttgacgaagtcgccgaactgcgcctcccacagcaccagggcgtcggggttgcccacggtgtagccgtactcgaagccgacggccgcgtactccgacagcggggagtcatacaccaggaatttgccgccggtcggggtgccgtcggggttggtcgccagcaactgcagcggggtgaactcctcgccggtgttgcggtcgatgatcaccgagtgccgttgcgagaaggtgccgcgccgggtgtcctgcccggacagccgcaccagcttgcccccggccaccagcgagcccagcgccagcagttcggcgaaggcccagtcgatcttgccctcgtaggccatctcccggcgcttctccagtaccggctgcacccgagggtgggcggtgaaaccctccggcagcgccaggaacgcgtcgccgatgcgggccagcagcgccttgtccaccgcggtggccaggcccgcgggcagcatctggtcggcttccaccgactcgctgggccccacgccgtgcttctccagttcgcggacctcgttgaacacccgctccagctggccctggtagtcgcgcagcgcgtcctcggcctctttcatcgagatgtcgccgcggccgatcagcgcctcggtgtagctcttgcgcaccccgcgcttgatgtcgacgacgtcgtacatggccgggttggtcatcgacgggtcgtcgccctcgttgtgcccgcgcttgcggtagcacagcatgtcgatgacgacgtccttcttgaatttctgccggaagtcgacggccagcttggccacccacgcgcaggcctccgggtcgtcgccgttgacgtggaagatgggggccccgatcatcttggcgacgtcggtgcagtactcgctggagcgggagtgctccggcgccgtggtgaagccgatctggttgttgacgatgatgtggatggtgccgccgacccggtagccgggcagatgggtcaggttcagtgtctcggccaccacgccctggccggcgaacgcggcatcgccgtgcagcatcatcggcaccaccgagaaggccttctcgtctccctggtcgtcggcgccgtgatccagcaggtcctgcttggcccggaccagaccctccagcaccgggtcgacggcctccaggtgcgacgggttggcggtcaacgacacctgaatgtcgttgtcgccgaacatctgtaggtacacgccggtggcgcccaggtggtacttgacgtcgccggagccgtgcgcctgcgccgggttgaggttgccctcgaactcggagaagatctgcgagtacggcttgccgacgatgttggccagcacgttgagccggccgcggtgcggcatcccgatcaccacttcgtcgagcccgtgctcggcgcactgatcgatcgccgcgtccatcatcgggatcacactttccgcgccttccagcgaaaagcgtttctgcccaacgtatttggtctgcaagaaggtctcgaaggcctcggccgcgttcagcttgctcaggatgaacttctgctcggccaccgtcggcttgacgtgtttggtctcgacccgctgctgcagccattcctgctgctcggggtcgaggatgtgggtgtactccacgccgatgtggcggcagtacgcatcccgcagcaggcccaggatgtcgcgcagcttcttgtactccgccccggcgaagccgttgaccttgaacacccggtccaggtcccacagcgtcaggccgtggttgaggatctccagatcggggtggctgcggaaccggctgccgtccaaccgcagcgggtcgatgtcggccatcaggtgcccgcggttgcggtaggccgcgatcaactccatcacccgggcgttcttgtcgacgatcgagtccgggttgtcggtgctccaccggatcggcaggtacgggatgctcagctcgcggaagatgtcgtcccagaacccgtccgacagcagcatctcgtggatggtgcgcaggaagtcaccggattccgcgccctggatgatgcggtggtcgtaggtcgaggtcagtgtgatcagcttgccgatgcccagttcggcgatgcgttcctcgctggccccctggaattcggcggggtactccatcgcgcccacgccgatgatggcgccctggccgttcatcagccgcggcaccgagtgcacggtgccgatggtgccggggttggtgagcgaaatcgtcacgccggcaaagtcttcggcggtcagcttgccgtcgcgggcccgccgcacgatgtcctcgtaggcggtgacgaactgggcgaaccgcatggtctcgcagttcttgatgccggccaccaccaacgaccgcttgccgtccttgccctgcagatcgatggccaggcccaggttggtgtgcgccggggtgatcgcggtgggtttgccgtcgatctcggcgtagtgccgattcatgttcgggaacttcttgatcgcctgcaccagcgcgtagcccaacaggtgagtgaacgagatcttgccgccgcgggtgcgcttgagctggttgttgatgacgatccggttgtcgatcagcagtttggccgggatggcgcgcacgctggtggccgtcggcacctccagcgacgcggacatgttcttgacgacggccgcggcggcgccgcgcaacgtctgcagctcgtcaccctcggccggcgggggagtggcgggcttggccgggcgggtgctcgccccgttgcccggggccgcggcgggctggggcgcgggccgggccggctgggcggtctgagccggcggggccgtttgggcgggcagggcgggctgggcggtttgcggggcagccggcgccggggcggacgggccgtcggtgctggccggggcggccagcaccgagtcgccggtgggctcggggttgtagtcgacgaggaattcgtgccagctcggatcgaccgacgaggggtcgtcgcggaacttgcggtacatctcctcgaccagccattcgttctgcccgaatggtgaacttatgttgctcacgaccgcagttcgcctcaatcccgttgtcccgcagggtcaccgcagcgctgttccgcggcgcctgccctcttgtcggtcccgggtgcccgagcaccccacactcgtggcggtcctcattgattccgccctataaaggctaaccttttgccgccgatccgcccacggagccggggttcagccggcttcgtggatgggcgggaccagatgcagcgcccgcggccagcgcgcgggcggcgcgccgaaggcccggttggcgttgcggatgatcttcttgccggccagatagttgccgacggcgccgacgacgacgccgatcccgacgggcagcagtttgccgaacagcagcgcgccccggcgcagcgtgtacctgcgcacccacgacttgagcagccgggagttcagtcgcgacatcgacgacagcggcagcgcggccaggctctcggagacccagccgccctgggtccgcccggggccgatcagctgggcgacggcccgctcgctgttgtcgccgacgagcacggccagcaccagcgcgcggcggcgttcccggtgatcggccgggatgtcgtagaccaccgccgccgccagcactaagaaggcggtggcctccaggaaggtcaccgtctcggcggccgccgcggacagcgcgctcagggtgccgatcccggggatggtggccgcggcgcccaccgcaacgccgccggcggtcacgatggccagatagcgtttctgcagcttggccaggatctcggcggggccggcgtcggggtgcgcgttgcgcagccgggtcacgtacgcctcggcggccgggccctggatccgcgaactgcgctcgatcacctgcgccaacgcccgcgcggacaccttgggccgaccgctgtcggtccgcgccgccgcgctggacgtgctgaaaaaccggttcggaaacctgttccgtcgggcccgcatattttctctcctgcaaatggcgttccttcaggctaacgtgccggcgccgcctcccggcgcgttatccgtccccggcggatccttgcctgccggcccattgccgcgccggggataatgcaggctggatgtctgcggcggccgggccgccgggtgccctggttgcggccggtcggccagcgcgggccgatccggcggaaacggcgccggacaggttcgtcgggagcgaaacgaggtggggtggatgaccacggctacgccccgcacgccggggggtgggcggcgcgcgccgtcggggcccgccccgggcgcccaccgctgggacctcatcacccgaagctcggcgcactcgcagaacccatggaacccgctgtgggcgatgatgatcggcttcttcatgatcatggtcgactcgaccatcgtcgccatcgccaacccgaccatcatggccgacctgcacatcggctacgacaccgtggtctgggtgaccagcgcctatctgctggggtacgcggtcgtgctgttggtggccgggcgtctcggcgaccggttcggcaccaagaacctgtatctgatcggcctggcggtgttcaccgtcgcgtcggtgtggtgcgggctggccggcagcgccgccatgctgatcgcggcccgcgtcgtccagggtgtcggagccggcgtgctgactccgcagacgttgtcgacgatcacccggatcttcccgccggagcggcgcggcgtggcggtcagcgtgtggagcgccaccgccggggcggccagcctggtggggccgctggccggtggggtgctggtcgacgggctcgggtggcagtggatcttcttcgtcaacgtcccgatcggggtgctggggctggccctggcgtactggctggttccggtgctgcccacccagtcgcaccgcttcgacctggtcggggtcgggttgtccggggtgggcatgttcctgatcgtgttcgggctgcagcagggccaggccgcgcactggcaaccctggatctgggcgctgatcgtcgcgggtgtcgggttcgtgacggtgttcgtgttctggcaatcggtcaatgtccgggagccgctgatcccgctggtgatcttcgccgaccgcgacttcagcctgtgcaacatcggcgtggccatcatctcgttcgccgcgacggccatgatgctgccgctgacgttttacgcccaggcggtgtgcggcctgtcgccgacccgctcggccctgctgatcgcgccgatggcgatcgccaacggggtgttcgcgccgttcgtcggcaagatcgtcgaccgctaccacccgcgcccggtgctcggtttcgggttttcgctgctggcgatcgcgctgacctggctcaccttcgagatgtcgccggcgacgccgatctggcggctggtgctgccgttcttcgcgatgggtgtggggatggccttcgtgtggtcgccgctgacggcgaccgcgacgcgcaacctgtcggcgcagctggccggcgccgggtccgcggtgtacaactcggtgcgtcagctgggcgccgtgctgggcagcgccggcatggccgcgttcatgacgtggcggatcggcgccgagatgccgggacagcccgccggcgggggtgaggactcggccgggccggtgctgcccgagttcctgcgcgggccgttcgcggcggcgatgtcgcagtcggtgctgctgccggcgttcatcgcgttgttcgggatcgtcgccgcgctgttcctggtgggttttcgcccgtgggcgcaccgcgacggcgggaccgacgcgttcgggccggacgactacggcggcgactatgacgacgactacgacgacgatgacgcgtacgtcgaactcatcctggtgcgtgaacccgaacccgaggcgcagcaacgcgccgggcagccgcgacggccgcagcccgccccggcaccgcccgccgacgtgcgccgccgtgaccccgtcgagtcccggcgcagcgtgctcgacgaacggcccgctcaggttcagccgatcggcttcgcgcacaacgggtctcacgtggacggcggcaagcggctgcgccaggtggcggtgcggcgcgcgcccaaacccggcccgcccgccgaccggttcacccggccgccgcgccgccaccaccccggcccggcgggtcaccacttgggcgaaggcgagtcgctgcgcggccagcaccaccgtcccgacccggacgacgaccccaccggttacggccggcactcgtcgggcaactagccggtcagcgcagatcgggctgggtgagcgccaggaacgcgcccagctcgatcagccccgccggcgtgccgggcaggtactccgtcagcgtcggcgaccgcacgatcaccgccgcgtactgggcccggctcaccgccacgttgagccgattcctgttgagcaggaaggagattccgcgcggcaccacgtccaccgacgaggccgtcatcgagatgaagaccaccggcgcctgcccgccctggaacttgtcgacggtgcccacccgcaccccgtccagcccggccgagcccaaccggcggcgcagcagcgccacctgggcgttgtagggcgccagcaccagcacgtcggaggcggtcaacgcgcgggtgccgtgctcgtcggtccacgacgccccgagcagtcccgtgacggcggccgcgatcgcgtcggcctcctcggggctctcggtcgaattgccttggtggtcaaccgaaagcagccgcaccccgggcgggcacccgtcgaggcgtcgggcggccgtgcacgcgtcggaatgcagcctgccctcgtaggacaacgcggacaccgcggcgcagacggccgggtgcatgcggtaggagcggtccaggaagtagccgcgttcgtcgggcagcgtgcgctgcccgacgaccagccagtccagcgccgacgtgtcgaccggctccgggtgggtgccctggctgacttgcggcagctgctgcgggtccccgagcagcagcaggttcgcggcggccggggccaccgcgatggtgttggccaaacagaattggccggcctcgtcgatcaccagcaggtccaggctgccgggtgggatccggttggcgttggcgaaatcccatgcggtgccgccgatcacgcagcccggcgtgtcggccaggaaggcggcgtaggcgttgccgtcgatctcctgccagcgcggggcctggcggtcgtagcgcttcttggcgatccgccgcggatccagtccggcatcgatcacgcagtccagcaggttttccaccgtggcgtgtgattgcgcgaccacaccgacgcgccagcggtgctcggcgaccaggcgcacgatcacccgggccgcggtgtgcgtcttgccggtgccgggcggcccgtgcaccgccaggtacgacgagtccaaatccgttagcgcggaggcgatgtcggcgacggtgtcggcgctgcggggcagcgcggcgccgctgcgggtgcggggcgcgcgacgcagcagcacgtcgacgacggcgctgtcgggcagccgcggcaggccggcggccaccgccgcgacggtcgcctcgatcgagtcccgcagcgcggtggtggggatgggcgggcccggggtcagcgcgaagggcaactggtgaaagggcttgccgtcgctggtgactcgttcgaggaccaccacctcggtgggcagtgccgggtcgtcggcctcgaccaccgtcgcccgcccggccgcccgccggtccgggttgtcggtcatgccgggcggcgccggcgggtcgtacagtgcgaagacctcggtgcgcagctcgccgcgggccagctcgccgcgcagccgcacccggcgctgcggcttgcgcgcgcgggcgggggtctgccagtcgacacacaccgacgcctgttcggcgacgaaaacgtcggtgttgtccgcccattcgtcgatggggaagttcagccggtcgaaatgcgcccaccagaagggtttgtcctcgcgccggtggtagccgcgggccgccgccagcagcgccactgcggtctgctgcggggtgcgctcgtcgatgccggcggccccggtgaacgccgacaacgtggccgccaactcgtcgcggtcgtcgacggtgttgccgtcgcccaccggttgcgcaccgacgggcagcacgccggattcgtaggcgcgcagcatcagccagttacgcagctcctgcgtggaccggcagtcgtagtggttgtagtcctcgatctccttgagcaccgcgaccgcctcgtcggcgcggccgtcggcctgcagttcgcagtagcgcgcgtaggaggtgatcgacccggcggccgtggtcacctccccggcgcgcagccggctgcccatgtacagcggctcgagcgccttgaggctgaacgagtccgcgcccacccgaatgctcctgcgcaccaagggatacaggtcgaccagtgtcccgctgcgcagcagttcgtcgacctggtcctcgcccaccccgtagcggccggccagccgcagcaacgcggtcttctcgtacggcgcgtaatggtagatgtgcatgttggggcggcgcctgcgccggttggccaccagcgccagaaagtcggtgagcgccttgcgttcctcggcccggttgtgcgcccacagcggccggaacctgcccgacggcccggcttcgaggaccccgaacaggtattccagaccccattcgcggccgtcggcggtccacagcgggtcgccttcgaagtcgaagaacagatcaccggggtcgggctcgggcagcagcgccaacggctgcggatcgacgatctcgacctgcggcaccccggtttcacgttcgcggacttgcagtttggcctgggcggtcagtttcgcgaccaccctggcggccagctccggcaccggcccgcggtgcgcggccagttcggcaacggtgctgatgccggcgtcaaaaagcttgtcccgctggctgactcgcatgccggcgaccagcagcacatcgtcggtggcgcgcagctgctcgacgcacaccgcgcagcggaagcacgcggtcacgttctcgtcgtcccagcgcaccgcggcgccgccggcgcggtgttcgtcgagcagccgctgcagccgggcccgggctgagcggtacaccgggaccaggtcgcacacccggtgccgcaccgcggttccgtcacccagccgcagctcggcctccggcgcgacggggacaccggcggcggccagcgcgtcggcgtaggcggccagctgcagcagcgcggtcaccttctccgagcgggccagcttggtgtccaccacctggtagcgctcgccgtcgcgcaccaggaagtcggcgaaccccaggaagcggccgtcgaacatggcggcctggtagatgacgggagcccggtcggcgaccgcgcggcgggtggcctcgctggccgccgtcagcgcggccggcgtgtaggccgggcggccgatgaccgcgacggcatcgccgaaccgctcgcgcagccgcgccagttcgcgccgctcgtgctcggcgcccagggtggccgtccggatcagcaggtcgtcctcgacggtgacggccggcccgcggccgagtttggcgtcgaaatcgcgcagcagcgcgaactcgcagcgtgcggcggcggcgagatccgacgcgctgtaaacgatgctgtcgccggtgacgaacacttcagccactgtaggtcaggggagggcaggcacgtcattgaatacctgatgtcaggtcacgatcgccggcatcgaatcccatccccgcaccgtcgaggtacgcgatcgtcgcgcgttgtccatgtcaatctcccactcgggccgtttgcgccactcgacgtaatcgctgaacatgtcgccgtcgaagtagtggtccttcctgatcggcatcggcccaccggtgtcgttctgcagcgtggcccgggcgtgctcgcgaaccgacggctggtcggcgtcgggaataccgagcagcatgccgatggtgcgcatcggcagctcggcgccaaggtcttcgacgaagtcgaaacggtcactgtcggcgaccatgtccaggctggccacgcagaacgcccggatcttgtcctcgagggtgcgcatcttcttgggcgtgaaggcccttgcgacgagagcccggtggatggtgtgcaggggaggatcctcgttgatgaaaacccccggcggcataaccggatcggccttgaccacatcgaggatgtcgcccttggctgaactgagccgcagcgggtctcgcagggcggcgtcgacgtcatcgtatctactgagaccccaaaagtcgtggcgttcgttgtagtacaacggcgcctcgttccgaagcctctggtaaatcgggtacggatcagcgtcgatctcgcggttccacgggtcgtaatacaaaccggtcatcgggaagcccgttctcagaaacgtggaaatcgttaccagcgttcgatgttggtgtcgtcctgtgtgaggggtcgcgcataggagacgtcgttggtgtcccagctgcccttgatgaagccggtgaagttacccgacttcagtgccgacccgtcgccctgcagggtccattccacggtgcacctgcgcagcgcgatcttccacgtgccgtcgcggcgttcgaggcggtcgatgtatcggccgcccatcatgatgagcgcgttgcccctgcgcgcctgcacgatgacgtagctttcgctgtgcgcgacgtcgccgtcgatctcgcagctgtgtgtcgtgatgttgtgcgagtgctggtcgaaggcagcggagtgcgccgcgttggcccaatcaccgtagtctgcagccgctttcaccgtaggtccgtgttcgtcaacgccgtcgtcggtgtagacactggtcatcagtgagacatcgtggcggtcgtgtccacgggcctgggtatggatgaggtcgcggatctcgatcttgtccttgacgtactgcaggtcgcggcgcagtgcttcgaggtcgatgtcggtggttgtcattgagatgctccttgctttggggtgtcaggattgattcagatgccggcgggaccggggccgccgtggatgtacagggtttggcccgagcagtagctgcttgcgtcggaggcgaagaagaggacgccgtagccgatttcatcgggttcggctattcgccccatggcgttcatggcgcccagctggtcgacgtcgaatccgcctttcgctgcgtctgccagcagtccgtctgttcggatggctccgcaggcaatgcaattgacccggatgccctttcgtccccaggccgcggccattgacccggtgaggttgttcacgccggccttggcggcggcatagatggcggcctgcggcatggcgatcaggctcgcgccggaggagatgttgacgatcgcaccgctgccttgtgtcatcatcggcttcactgcgcacctcgacaggaaccacacactgccgaggttgaggtccacgacgtcgtgccactcttcctcggtccatctggtgatgcctttggtttcacccccgcccgcgttgttgaccaggatgtcgagtctcccgaagtcggccagggtggcatcgacgaggtcctggcactgatgggtttcggtgacgtcggtcggcacgatcaacgcccggcgtccgagcgcctcgacctccttggccgtcgcctgcaaaggatcgggccgccgtccggccagcacgatatccgcgccgtgctcggccagcaccaaggcgctggcccggccgatgcccgtgccggcgccggtgatgacggcaactctgtcggtcagcgcgaaccgatcactcatcgatcaactcctcttgtctgccgcggcaacgccgcacgggacgcacgatcatgcgccgtcgccgtcgacggaaagtcctgcctgggcgcgaagttctcggacgtcgtcctccaagcggacctggcaggttttcagcatgcgcatcagggcgtcgtagctagtgaccgtgaacatggtgtccagaagttgctgggtgccgaattcgctcgacagggtggcccacgtggcatcgctcatttggccgtcgtggatgagttcgtccacggaccgcagaagcgcggcgtcgaagtcgctccaatagggcgcggtcggaccgaaggcgatccgcgcgacatcttcggtgctgatgccgccgtcgggcgcaatgaagttgtgatgtgtccattcgtaggcggatccacgcacggcggcggtgcgcaggatgagcatttcgcggtgccgcatgctcagcgtggttcccatcagcaggtgtccctgcagcgtgcagaacgcccgcgccagggacgggtggtgtgccaacgtccccagtgcgttccccgctttggggcggtccttggtgaccggtgcggggtggcgcggattgggtggcatcagggcggccatcgcgtcgcgcatctccggcggccagtcccggaaacgaagtggtgtcacgcgtgacatggaagctgatcctttcgagttgtgttgtacggctgcttatttgaggagggcgccgccgtcgaccggtagtgcgaccccggtgatgtagcgcgcgtcgtctgagaccagaaagaggatggcgttgctgatgtcggcaggttcgacgtacggaatcggaagcacgtgcatctgccgtgacgcgaccttgaagtcctccacggtgggattttccaagtcgggccgaaacatccggtaggtcggctcgttgagcagcatgggtgtggcgacgctgctcgggcacacgatgttgacgcggatgtttcttggaccgagttccagggccatggtgcgcatcaacccgtgcagcccgtgtttggacgcgatgtagttgccgatgttctcggcgccgcggaggccgccgatggagctggtgaacacgatcgagccgccgcgcttaccggccatgatgtgaggtatcgccacccgcgcggtgatccacgcgccgttgaggttgacgtcgatcatgtcgcgccacgtcttcgggcccatccggttcagccgcgtgccctcactggcgagggcggcattggcgagcacgatgtccaggcgcccgagctgtgtgacaccgtcgtcgaccgcggcctgcatggcgtcgaagtctcgaacatcgacctgcgacgcgatgatccgccgtccgagcgcctcgacctggcgcacggtctccgccaggtcgtcgggcgtggacatcgggagtttgactccgtcgagctgcttgcacacatcgatggcgatgatgtcggcgccctcacgcgcgagcgttatggcgtggctgcgcccctgcccgcgcgccgcaccggtgatgaaggccaccttgccctcgacctttcctgccattgggacgtccattcccttcgtgattacatccgctatacgaacgtacaggttactagaacggtacaatacacccgtacagcggtcgtcggcatgtgaaaatgcttaaaccatcagggaggtggacatggcagcatcgccccgccgcgtaggagcagagacttcacagacgcgcgacgccttgctcgaggccgttgcgcagatgatgctggaggagggatatgcgagcgtcacgtatcgcgcattggccgcgaaggccggcgtgacgccaagcctcgtccagtactacttcccctcgctggatgacatcttcgtcgccgccattcgccgctactccgagcgcaacctgcaatggttgaccgaggaacttcagcggcgagccgacgacccacttcatgcgctgtgggagagcggctggcacgagtcgacgagtgcgctgatgacggagttcatggcacttggcaaccaccgcaaatcgattcgttccgagatcgccgccgtgacggatagcatgcgcagagtccaggtcgaggcgctggtggcgaaattcgggaacgacgcccggctcctcgctgatctttcgttcgatgccgtggtgctgttgatcaacggcgttccgaagctccttgggttggaggaaagcgtgggcgtcgataccgcccacgccgagttgatcgccgcgtgcgagcgctttctggacgccgtcgaacctcgagccaagcctcgccgtcgcagtaagaaggctccgactcgccgacgctgactcgttgcggcgggtgcttcacgggaggccttgtgaccgcgctgtacgtccgtatagactggacgatcgtatagcaggtgcagggggtggaaggcgagcattgtgagtcgcgtggcggtagtaaccggcggtgggtcgggaatcgggcgggccatcgtcgaacgactggcccacgaccgccatcgcgtcgccgtgttggacgtaaacgaagaagccgccgaaaaggtggcggcgcgggtggcggccgacggcgcccacgcaatcgcggtaccgaccgacgtcgccgaaagcgccagcgtcgcagcggcgttcgagtcggtgcggcgcgcgctcggccccgttcaggtcttggttaccagcgcggcgatcactggcttcaagccgttcggcgagatcacgatcgaggactggaaccgccacctcgcggtgaacctcaccggcacgtttctgtgcctgcaggctgcgctgccggacatggtcgaggctggttgggggcgtgtggtcacgatttcttcgacggcggcacagacgggatcgccccgacaaggccactactccgcatccaagggcggtgtgatcgcgctgacgagaacgatcgcgctcgaatacgcggtccacgggataaccgccaacacggtgccgccgttttccgttgacaccccgatgcttcgcgccgcgcaggaggcgggaaaccttccccccgtcaagtaccttgccaaggcatccccggtcggcaggctcggcaccggcgaggacatcgccgctgcgtgcgctttcctgtgctccgacgaggcgggctacatcacgggtcagatcatcggcgtcaacggcggcgcagtgatctgaaccagcggcacatgcggattgaagcaagcaacgatcacggaggtgttcagtgaaggcacgcgttgacgctgcccgatgccaggggcacaccctgtgcgcgatgatcgcaccgaaagtcttcgaactcgacgatgtcgatggccacgcctccgccgtcatgggtgaggtagccgcagaggacgaagcgcaactgctcgaagcagcgcgctcgtgccccgagcaagccatcgtgctaatgaacggcaccgtcggtcaaggggccggcgaatgagcgtcgaggtcgctggttctggctcccgcaaggccccgcagttccacttcgatcggcacacgccggaatatcgcgagcgtttcctcgacgtcacccaggaaatgcaccagcggtgcccgatcgcttggactgacacctatggcgggcactgggtagccgccggcgccggcgccgtcttcgaactcgcccggtgtccgcacgtgtccaacgaccacgacgtcaacaacgaacgacgtggctacaggggtgtcaccattccacttacgacggagtcggaccagatccgcggcggaatgctcgagatggacgacccggagcaccgaatttaccgctcgttgctgaacccctacctttcgccggctgcggtgagtcggtggcagccgttcatcgacgacgtagtgcgggcctgcctcgacgaacgcatcgagagcggtcgcatcgacttcgtcgacgatctagcgaacgtcgtgcccgcggtgctcaccctggcgatgctcggtgtgccgctgaggaaatggaccatgtacaacgagccggtgcacgcgatggtgtacacgccgccgggttctcccgaggctgccaaggtgcacgacatgtgggtctcagtggtggttgacttgttcgccaacctcaccgagatccgcgagcacccgcgacccggcatcatcaacgcgctggcacagctgcgcatcgacggtgagccggcgccggacatggagatcatcggcatgctcacgctactgatcggtgggggatttgacaccaccacggcgctgacggcgcacgcgctcaagtggctgtccgagcatcccgatcagcgcgcacggctgcacggcgaactcgatgtcctgctgaacccggccaccgaagaattcctgcggtatttcaccccagcgcccggtgatgcgcgcaccatctccgccgacatggaactggacggcatccgcttcgccgagggcgagcgggtgtggctctcgtgggcgatggccaaccgcgatcccagcttgttcgacaatcccaatgaactgatgcttgctcggaaagctaaccgccacttcagctttggcatcggagtgcaccgctgtatcggctcgaatgtagcgcgcaccgtgttcaagtcgatgctcactgcagtgctcgaacggatgcccgactatcggtgcgatcgggtgaataccgtgcactacgacaccatcgggatcattcagggcatgcgcaaccttcccgctgacttcactcccggcaagcggctagggccgggcttggatgagacgctcgatcggttgcagtccgtgtgtgacagccagggccttgcccgacctatcaccgagtacaaggagcaagcccgtctccctggatgacgaccacgaccactggcgcatatccgttgacgtgcagaaagattggagagcggcgatgcggatcgggctgaccggcggcgcgtcatcgaccgacaagatcgtggagcaggcccaagcggctgaagccgagggcttcacgtccctgtggtacgccagcacggtggccggcgacccgctggtggcgatggccctggcgggacgggccaccacatccatcgaactgggcaccgccgtccttcagacgtatccctgtcacccgctgctgcaggctaaccgggtagccgccacggcaaatgccatgggccgcccgggattcacgctcgggctgggcccctcgcacgagccgctcgtcagcggcgtgctcggcttgtcctacgaccatcccggcaggaacaccgaagaatatctgcgcatcatcagtgccctgttgcggggcgaggaagtcgactactccggtcaggactggacgacccgcagtcccgccggggtggtcagactcgactatgaggtgccgctgctgctgtcggcgctgtcaccccggatgttgcgcattgcaggtcgtttcgccgatggagtcgtgctctggatggcgtcggcatcggtcatcgaatcccgcatcgcacccgcgctccgccacgcgaccacggaatggggtcggccaccgccaaggatcgtcgccggactacccgtcgccgtgcacgacgacccggtcgaggcccgggcggccaccgcggcgatgtcgacgatgtacgcggggatgaccaactatcagcgggtcatcgaggcgggcggcggcgccacccctgccgatgtcgcgatcatcggcaacgaggagtcggtgcgaaaacaactgcaggacctgctcgatgccggagccaccgacatctgggcacagcccatcggagtcggtgatgagcgagcacaacgaacggcatcggcccaacgcactcgggaactgctcagcgaactcgcccgcctgggttaggacttctgaccactacgcgactatgcgtgatgagctgcgatagccgagggcgtcgccggcctgatcgcctccaagacgcgacccgtccctccggcgaagtagacggcgagatgccccgtcggtttcgtatgccgagcgtgggcgatctaatcgaaaggtaagtgtgtgacaaagaaattgcgcgtcatccagtggaccaccggcaaggtcggcaagctgagcctgcggggcgtgctggacgatccgcggctggaactcgttggtgtctacgcattttcggaggagaaggcaggctcggatgcgggtgcgctgtgtggccgccccgataccggggtgttggccaccaccgacatcgacgcgctgctcgcgttgaaagcggacaccgttatctacaccccgttcatggccgacatcgacgacgtagtgcgtctgctcgaaagtgggctcgacgtgatcagcaccaacctatttctcaatgtcggcggcatccagggcgagacaaagcagcggctggcggcggcgtgccaacgtgggggcagctcgctctacatcaccggggtcaacccggggtggatcaacaccatggtcacggcgatgaccgcggtctgccgtgacgtcgagatggtgtcggtttccgagtctgccgacgtgtcggtctacgagtcgcccgaaacctggcagtcgcaaggcttttcactgtccgaggcgccgcccgccgtgatcgagacggccaagatgtggctgagcacgtttcgcgattcggtccagcgaatggcggtcgccctgggcttcgagctcgacgacatggaattcttcatcgagcacgccaccgcgtcggagcgggtcgatctcggctggtgggtcatcgagaaagacaccatcgccgcgatgcgggccggctggaacggcaaagtcaacggcaagacggtggtgcaatcgaacgtcgcctggtacatgaccaaactgctgaacgagggatggcagttcgacgacgaccactatcacgtcgtcatcaaaggcgagcccggcgtcgacacccggattcgcttcctgccacccgacagctggggcaaccacgaatgggacaccatgacggcgatgcccgcggttagcgctgccgtcgacgtcgccgccgcgccggccggtatcttgaccctcaaggacgtcgggctgccgtgcgcgccggccggtttatggctcgagggctgaagcatctccatgcgctgcacttcagcgccggggcgccgacaccgccgcggtgccgggcgcgcgtgccccggggtcagtgcgcgggggtgttgccgatcagctcgacggcattgccgttccagtggaacttcacgtcggtgctcaggccggaaagcccgcccgggtaggtcagcgccaccgtgtcaccggtggtctgggccgggtcgatgccgttgaacccgtaggtgtcgggcaccccctgcgggatgaattggccgaggtggaacagcaccgcccgggtgctcgggctgatcgcgttggtgttggccttgacgatcaccgccgacagctgcgcgcactggttgtagttgccggccagcggctcggggttccacggctgctggctgcgcgggtcgcgcggcagctcggagaccaccttcgcgatggtcggtgcggcgaggttgaccgcgcacgggtcggccggctgcccgacgccgggctgcgcggcggccgccgacggcgtggccggtgcggtgatcgacggggtctccgacgtcgtgcgggcctgcggcgtcttggcgacggtggagtccccggaaccgcatccggtcagcgtgacggcgatcaaggcgacagcggccgagccggtcagcggctcggtacgacacggtggcgaccacacatcgacgcaccgtaccgtcatcgcggccgcgggtgtggcaggcgtggccgggcgtcgcccggctgtgcccacgatcacgggccgcaccgggcgcggcgcgaccactagactccatgggcgatgaccctcccggacagctcgactgaggctgcctccccgacatttgccgacctgcagatccatccctcggttttgcgggcgatcgccgacgtcggctacgagacgcccaccggcatccaggccgcgaccatcccggcgttgatggccggttccgacgtcgtcgggctggcccagaccggcaccggcaagacggccgcgttcgcgatcccgatcctgtccaagatcgacgccgccagcaccgccacccaggcgctggtgctggcgcccacccgggagctggcgttgcaggtggccgaggcgttcagccgctacggcgcgcatctgccgaagatcaacgtgctgccgatctacggcggctcgtcctacgccgtgcagctggccggattgaaacgcggcgcccacgtggtggtcggcacgccgggccgggtgatcgaccacctcgagcgcggcacgctggacctgtcgcacgtcgactacctggtgctcgacgaggccgacgagatgctcaccatggggtttgccgaagaggtcgaccgcatcctgtccgagaccccggaatacaagcaggtcgcgctgttctcggcgaccatgccgcccgcgatccgcaagctcaccgccaagtatctgcacgatcccctcgaggtcagcaccaaagcgaaaaccacgaccgccgagaacatttcgcagcgctacatccaggtcgccggcccgcgcaaaatggacgcgctgacccgggtgctggaggtcgagccgttcgaggcgatgatcgtgttcgtccggaccaaacaggccaccgaggaagtcgccgaaaggctcagggcgcgcggcttctcggcggccgcgatcaacggggacatcccgcagggccagcgtgagcggaccgtcgccgccctcaaggacggcggcatcgacatcctggtcgccaccgacgtagccgcccgcggcctggacgtcgaacggatctcacacgtgctcaactacgacatcccgcacgacaccgagtcctacgtgcaccggatcggacgcaccggccgggcgggacgctcgggaaccgcgctgctgttcgtctccccgcgagaacgccacctgctcaaggccattgagaaggcgacccgccagccgctcaccgaagccgagctgcccaccgtcgaggacgtcaacgcccagcgggtggccaagttcgccgactccatcaccgccgcgctcggcgctcccggcatcgatctgttccgcaagttggttcaggactacgaacgcgagcacgacgtcccgatggccgatatcgccgccgcgctggccgtgcagtcacgcgacggcgaggagttcctgatggcgcccgaaccgccgcgggagcgacgcgaacggcacaccgaacggcgcgagcgcaccgagaaacccaggagcacaaggccgttggccacctaccgcatcgcggtgggcaaacggcacaagatcggtccgggcgcgatcgtgggcgccatcgccaacgagggcgggctgcatcgcagcgatttcggccacatcgccatcggacccggcttctcgctggtggagttgccggccaagctgcccaagtcgacgctgaaaaggcttgagcagacccgcatctccggagtgctgatcaacctccagccggaccgggcggcggccaaggcgcgcggtcgggacggcgggaaaccacgcaggaaatacggcggatgacgctgtcggaagaacaagacgcccagggcgggctcgagcagacctctcgcgtcgaccgcgtcgcctcgctgaccggggtccgtgcggtcgccgcgctgctcgtcgtcggcacccacgcggcctacaccaccggcaaatacacgcacgggtattgggggctggtcggttcccggatggagatcggggtgcccatcttcttcgtgctctccggctacctgctgttccggccgtgggtgaagtccgcggccaccggcggcccaccgcagtcgctgagtcgctatgcgtggcaccgggttcggcgcatcatgcccccctacgtcatcacggtgctgttcgcctacgtgctgtaccacttccgcgaggctggtcccaatcccgggcacagctggctgggtctggcgcgcaacctgacgctcacccagatctactgcaacggctacctgggcaagtatctgcatcaggggctgacccagatgtggagcctggccgtggaggcgtccttctacgtcatcctgccgctgctggcctacctgctgctggtgctgatctgccggcggcagtggcagccgaagctggtgctgggcccgctggcggggctggcgttgatcagcccggcctggctggtgctggtgcacaccgatcactggtttcccgacggcgcccggctgtggctgcccacctacctggcctggttcctggccggcatgatgctgaaggtgctgcaggaaatgggcgcgcgcgcctacggtttcgtggccatcccgctggcggtggtcagttatttcatcgtctccaccccgatcgccggcgcgcccacgacgtcaccggccacgctgagcgaggcgttgttcaagacctgcttctacgccgtgatcgccgctctcgccgtggcgccgctggcgctgggcgatcacgggtggtattcgcggctgctggccagccgtccgatggtgtggctgggggagatctcctacgagatcttcctgatccatttgatcaccatggaattcgcgatggactacatcgtcggcgcccgcgtctacaccggctcgatgctgaacctgttcgtcgcgacgctggtcctgacgatcccgttggcgtggctgctgcaccggttcacccgggtgcgcgactgagccggcggggcacaccgtcgcgcacccttcgtcacatgggccgcagcggcctctccgagagcggacaggcgatgtgcccgcctcacagcgacaactcggttacgggtgcgagcgcaccaacaggttgtcgctcagaggcgggcacttcgaacaccggctgcgggccggcccgccgcgacctgcgggcttagccgcgggcggacaccggcgtcacgatcgggacgacgaactcttcgatcatcgcccgctcgtcggcctcgtcgtgtccgggaaacagcagcagcgacgtgatcacccggaccacccagcgtgcccggcgctcgacgacggcgggctcttccgggcccagcgagccgacgaacgcggcggccagggcggtgatcacctcggagtgttcggccagctcaccggcgatgggcgggcgggtgacggcgaaccacgacgccagcgcggggttgccgcggaccatccgcaaggtggtggtgatgctcgcggtcagccgctggcggggctcgtcgatgccgtcgatctgttccatgatcgcccggcccagccggttggcctcgcggtgcacatacgcggtgcgcagcgcctcccggttctcgaagtaccggtacagtgtggcgcgggaacaccctgcggccctggcgatttcgttcatgccgatggattccgaatcgcgctgggtgtagagctcctgggccgcgtcgaggatccggtcgacggccgcctcgttgcggtgtccggaaagccagtcggtgctcctgcgcgcgccgggcatcaggacttcacccggatcggcaccgacagcggtcgccggacgtagttgccgcccgcccacacgatgcccgactcgtccacctcgaagtcggggcagcgggccagcagctcggtcagcgcgacccgcgactgcatccgcgcggcggccgcgcccaggcagtggtgcgcgccgtggctgaacgtgaggatgttgcgcgggcagcgggcgacgtcgagttcgccggcgtcgggcccgtactggcgttcgtcgcggttggccgacccgtacagcagcagcacccggcgcccggccgggatggtggtccggccgatcgtcacgtcccgggtggtggtgcgggccagcccctgcaccggcgaggtcagccgcagcagctcctcgacggcgtcggggatcagctccggctcgtcgaccagccgctgccgttggtcgggccgctggtgcagcaaaggcattgacccgcccagcattccggtggtggtgtcgttgccgccggtgaccatggtgaacgtgaaggccagcaccgacagggtgccggcgatgtcgccgtcggcgcccaccccggcggacaccagatgcgagatggtgtcgtcctcggggtcggtccggcgccgctcgatcagcccggtgaagtaggccatcatcgacgtgaccgcatcgcccgcactgcccagcgcgccggcgacaccgccgtcggccgtgttggccgccacgatggcctcggtccagccgtcgaattgtgcccgatcttcctcgggcacaccgagatagtgggcgacgaccatcgacggcagcggtttgaacagctcggcgacgatgtccccgccgccggccgcgcgcagccgttcgatgcgctcgaccacgaagtcgcgcaccttgggctccaccgcctcgacctgccgcggcgtgaagctgcgcgacaccagcttgcgaaactcggtgtgcaccggcgggtcctgcatcacgaacggcggattgtcttgcagcccaatgagttccaggtcgtcatagttgaccgtcaaacccttcgccgaggagaaggtttcgtggtcgcgggccgcggcccacacgtcggcgtgccgggacagcacgtagtagtcgtgctccgggcgcttgggcgggacgacgtggtgcaccgggtcgtggtcacgcagcgcgcggtacatcggccacgggtcggcccaggtgtcggcgttgggcaactcgaacgccaccggcacgttgtgagacacagtcgatgttatgtctcattcgtacgacagttacgggcgctgtgtcaaccccgtcgtggcctcccgtcacgctggcgtgacgctcggcgggcgaagccacgctggcgtgacgctcggcgggcgaagccacgccagcgtgacgcacggcgccaacttggcaacaaacagctcagatccccgacccggggttcaagatgccctgcgggtccagcgcctgcttgatccgccggttgaggtccatcacctctggccccaggtagccggccagccagggccgcttcagccggccgacgccgtgctcgccggtgatggtgccgcccaggccgacagccaggtccatgatctcgccgaacgccaggtgtgcacgctcggtcatgtcggcatcggcggggtcgtagacgatcaacgggtgggtgttgccgtcgccggcgtgggcgatcaccgagatcatcaggtcacgttcggcggcgatggccgcgatcccggtgaccagccggcccagcgccggaagcggcaccccgacgtcttcgagcagcaacgaccccttggcctccacggccggaatgcagaatcggcgggcgacgacgaatgcctcgccctcgtccgggtcgtcggtcgaaaacacttccgtcgcagcgttttccgcgaacaccttggccatgatctcggcgtcctcgctgccggcgcggccacgctcgtcggacccggcgaccagcatcgcggccgcgccgcggtccaggtccatccgcagggtgtcctcgacggcgttgatcgcgacggagtccatgaactccagcatcgacgggcgcagccgcccggtgacgccgagcaccgcgccgaccgcatcctcgaccgtggcgaagctggccaccacgacgctggaggtgttctgcttgggcaccagccgcagcgtcacctcggtgatgacgcccagggtgccctcgctgccgacgaacagcttcgtcaacgacagccccgcgacgtccttgagccgcggcccgccgagccgaacggcggtgccgtcggccagcaccacctgcatgcccagcacgtagtcggtggtcacgccgtacttcacgcagcacaggccgccggcgttggtggcgatgttgccgccgatgctgcagatctcgaacgacgacgggtccggcggataccacaggccgtgctcggcggccgccttcttcacctcggcgttgaacagccccggctggcaaaccgccgtgcgggtcaccgggtcgacggtgatgtcgcgcatcttctccgtcgagagcacgatgccgttgtccagggcggtcgcaccgccggacaggccgctgcccgcgccgcgggtgaccaccgggacgccgtgcgcgctcgcccagcgcagcacggtctgcacctcctcggtgcgccgcggccgcaccacggccagcggttttccggccgacgggtcgaacgcgcggtcctggcggtagccctcggtcaccgtcgggtcggtgaccacagtcccgtcgggcaggtcggcgatcaggctggccaaggcttcggagctcaccgcccgatcctaagcccgcctcacggacccgggtcgtcggcgaactgcggtgcccggtccagttcgcgcagcgacggcaggccgcaggccacgacaccgatcgccaggatcggcaccgccaaggtcaaaaaggtggccttcagcccggcggcgtcggccagtgggccggcgaccagcagccccagcggccccgccgcgtaggtcagtccggccatcaccccgaccacccggccccgcaggtgatgcggcgcccgggtctgcatgacgaagttgtagatcggctggatcgggccgtacaccacgccggtgaccgcgcacagccccaggatcaccggcaacggcggcagcaccgcgataccggccgtcgtcgccccgaaggtgagcgtcgccgtcagcaccgccgtccgccgccgcaaccgtgctgacagcacggcatagcctagcgcgcccgccaccccgcccaacgccagcgccatcagcgcccaacccaactcggccggctggtgctgatcggcgaaatacttggggaacaacacgctttccatcggcagatacagcgcggtcacggccaggtcgatcagccccagcgtgcgcagcacccgcaggttccagacgaaccgcacgccctcggcgatgccggtcaccagcccgaccgggcgggtcgcccgcggcggtttgccggcaccgtcgagccgtagcgccccaattgccaagaaggacaaggcgaaacaacccgccgtcacccacatcgtgttgatgccgcccagcgtggcgatcagcaagccgcccagccccgggcccacgatgaaagccaggttcagcatcgcctcgtagctgctgttggtgcggtccagcgaccagccggcccgcgcggcggcctcgggcagcatggactggcgcgccgtcatcccggccgggtcgaaagcggccgcgcagaaggccaatacggccagctcggcgacgtcgatggccgcggcgccgaagatccaggcggtcagcggcaccgccgtcaccgccgcaccggacagccaatcgcagaccagcgacacccggcggcgcccgaaggagtcgaccgcggtgcccgcgatcaatgtggcgagcaccaacggcagggtcatggccgcggccacgatcgacgcgtcggtggcgctgtgccggtgctgcaacgcgagccacgggaaggcgacgatcgatatgccggtgcccgccgtcgcaagcagcgttgcgaacaagatcaaaagggccgggccgcggctcgtgtcaggcatggggatcgcggggagaatgtaaccgcataccctgggcggcggccactgaatttcgtggtggccggccgcgaatgcaggatgttggtgtgctcgagcatccgcgtaccggccaggcgttcgactcgccggtgccggccggtagcggatggccgggggatccggccaccccgcagaccccggtcgccgccgatgccgatcaggtgatcgcgttggcccgccacgccggcgcgattcccgaactcgacgcgctggtcagcgtgtgccgggcctgcccgcggctggtcgagtggcgcgaggaggtcgcggtggtcaaacgccgcgccttcgccgaccaaccgtactggggccggccggtgcccagctggggatcggcgcggccccggctgctgatcgtcgggttggcgcccgccgcgcacggcgccaaccggaccggccggatgttcaccggcgaccgctcgggcgaccagttgtacgcggcgctgtaccgggccggtctggtgaaccagccgaccagtgtcgacgcggcggatgggttgcgcaccaagcacattcgcatcgtcgcgccggtgcactgtgccccgccggccaatgtcccgacgcccgtcgagcgggacacctgctggccctggctgcaggccgaatggcggctgatctccgagcatgtccgggtggtggtggccctgggcggcttcggctggcagatcgcgctgcggctaccgggcgtgccggccgcgcgcaagccccggttcgggcacggcgtcgtcgccgagctggcgcccggtgtgcggctgctcggctgctaccaccccagccagcagaacatgttcaccggtaggttgacaccagcaatgctcgacgacgtcttccgcgacgcaaaaggactggcggggatcaagtgagttgtcatgtctgacgtgctggtgtccggtgccagcgtggccggtacggcggcggccttttggcttgggcgccatggccattcggtgaccgtggtggagcgccatcgcgggccgcggccgggtggtcaggccatcgacgtgcgcgggccggcgctgggcgtgctggagcgcatggggctgctggccgccgcggcgaagcgcaggacccagatccgggggtcctcggtcgtcgaccgggacggcaacgagctgtcccgggacaccgaagccgcgatttctggccccaccggcgggccgatcgagggccccgacatcgagttgttgcgcgacgacttggtcgaattgctttacggcgcaagccaatggaccgccgagtacctgttcgacgacaccatcaccgcgctcgacgaccggggcgcggcggtccgcgtcaccttcgagcgcgccgccccgcgcgatttcgacctggtgatcggcgccgacggcctgcactccaacgtgcggcgcctggtgttcgggccggaagacgagttcatcgagcggttgggcacgcacgcggcgatcttcaccgtgcccaatttcctgggcctggactactggcagatgtggcactacggggactccaccatggccggggtgtacagcgcccgcgacaacgcggaggcccgggccatgctgggcttcatggacgccgagctgcgcctcgactaccgcgacaccgaggcgcaattcgccgagctggagcggcggatggccggcgagggatgggtgcgcccgcagctgctggagtacatgcggaccgcgccggacttctacttcgacgaaatgtcgcagatcaagatggaccgctggtcgcgcggccgggtggcgctggtcggcgacgccgggtactgctgctcgccgctgtccgggcagggcaccagcgtcgcgctgctgggcgcctacatcctggccggcgagctgaaggcggccggtgaggaccatgaagccggtttcgccaactatcaccgcgagttcgccgactacgtccagcgcaaccaatggctggtggtggacaacatcccgggcggcgcgccgataccgcaggaggtgttcgagcgcatcgtcgcctcgatcgcgctcaaggactactgatcctcgggtgcccgcgcgccgggaaggtttgccggcgccggcgcgttgacgccagcgtgcgtctttccgtcctcgatctcgtcccggtgcgcaccgaccagaccaccggcgacgcgctggccgccaccgtggcgctggcgcaggccgccgatcggctcggtttcacccgctactgggtggccgagcaccacaacatgccgtcggtgggcgccaccagcccgccggtgctgctcgcgtacctggccccgcagaccacccggctgcggctcggctcgggcggggtgatgctgccgaaccatgcgccgctggcggtggccgagcagttcgcgctgctggaggccgccgcgccgggccggatcgacctcggcatcggccgggcgcccggctccgatccggtcacctcgtacgcgctgcgcggcggccgcggcgacgaggacatccagcgcttccccgactacctcgacgacgtggcggcgttgatgagcgcgcgcggcgtggtggtgccgctgcgctcgggggactaccggctcagggccacccctgccgccgccggcgagccgcggctgtggctgctgggctcgtcgatgtactccgcgcacctggccgccgccaaggggttgccctacgtgttcgcccatcacttctccggcaagggaaccgaggaggcgctcgaggtctaccggtcgcggttccggcccagcgcgctgacgcccgagccgctcacctttttgacggtcaacgccgtagtggccgaaacccgggacgaggcaacggctttgatgctgcccaacctgcagatgatggcgaagcttcgcaccgggcagccgctcgggccggtgccgctggtcgaggaggccgagcacgccgagctcaccgccgagcagcggcgcatcgtggacagcgggctgcggcgcgcggtgttgggcggcccggccgaggccgccgagcaggttcgggcgctcgccgagcggttcggtgtcgacgaggtgatggtgaatccggtggcgtcggcccgccgcgggacggaccccgccaccgcgccggcccgggtcgcgacgctggagctgctggccaaggagctgttctgactcccgggcgaactcacccccgggactggctgggatccggcgcgtggctggcgatccaggcccgcagctcgtcgggcggcagcggcggggtgtgcacgaagccctgggtgatgttgcagccgtagcgtcgcagcgcgtccaaggtgtcctcgttttcgacgccctcggcgaccaggtcggcgcccaggttgtccgccagcgccaccgtggaccgcacgatggcgaccgagcgcgcatcgtgagccaggcgcgccacgaaaatgcggtccagcttcaactcgtcgaccgaaacctcctgcaggcgggccagtgacgaccagccggtgccgtagtcgtcgatcgagatgcgaattcccaagcgctgcaacgcggtcacggtgttgcgggatcgcaccgaatccaccagcgcgctctcggtgatctcgaggatgagcgcgtccgcgggcaggtcgtagttggcgagcagtctttccacggtgccgacgagctcgatgtcgagcaggttggtggtggacaggttgaccgcgacggtgaggcgcagaccctcttcgcgccaggagcggacctgttgcaacgccatgctcagcgtgcggttggagatcttgcgcatcaacccggcgcgttcggcgacgggcaggaactcctccggcagcaacgtcccgcgggtgggatgctgccagcgcaacacggcctcgacgctgtggatgctgccgtcccgcccgtcgatcttgggctggtagtgcagtttcagctcgtcggtgtcgaacaacgcggtgcgcagttcctcgatgaggttggtgtcgttgtcgcggtgggcctcgaacgcggagtcgtagaccgcgatcttgcttcgcgccgatttggcgtgcgccagcgcggtttcggcgcggctcaacagctcccggggatggtcgcagtgatccggacacagcgcgatggcgatgcggccgtccacctgaatggtgatcggatccagggcgatcggttcgctcaacgcctcgagcagccggcccgcctgagcgctcgcggcggtgaggttggcgccgtcggccagcagcacggcgaactggtcgtcgcccacccgggcgagcaggtcgtcgcgacggacgctgccggccaatcgattcgcgatgtggcacagcagctcatcgccgaattgccggccgatcgattcggtgatctcgtgaaagtcgctcaggctcaacaacaacagcgcgcgacgggggtttgcccggctcggcatcgaaccggcgccgggcgatgccgaggcgggcaaaccctgcagggccgtcaccagctggcgccggttgggcagcgcggtcagctcgtcggtcatggcgtgccggtcgtggctgtgcagcaggctcacgtcgcggaaggtcagcgaaaaccgcccggctccgaccaccaggctcaacgccgccagggtggcggccgaacgcgaatgatgggccagcacaatcactcccagcgccacaatggtggacgccaccggagtgacataggggctgaagcggcgtcgggcctgcgtcgccgtggcgggcggcggcgcccagctcgccatcgcgatgagcaccgacgacgcgggccagcacacgtccagcagggaaccgacccgatacgatccggccgccgtctggaacaggtaggccccgtcggcgaccgcgaacaaaaccagccccgccaccagcagcgcccagcgaatctcgttgcgccagcccaagatcggcagcatgccggcggccagggccagcagcatcagatcgcaccacgggtaggccagccccacccacaccgtcttcggtgcgtgcaccgccgcctggtgcagcgggcccgcggtcagcgccgcggccaccgcggtcaacgtcaacgcgcacaccaccgagtcgagctggaccgcgatcggcagccgcttgagccgggcccgcatcagcagcagcaatccggcgtagacgaacgggtagtaggccagatactccgggtcggccaccgacggtgagcgcccgtcgggcacccacaccgcgtacacgacgtcgcccaccgccgagcacgccatgccggcggcgatcagcgcccacgcccaccggtcggccggaatccggcaggcgcgcagcgcgatcagcccggcggcgacggcgttcagcgccgaatacagcgccgtcgccgagaagattccgtgcccggcgtccggatgcgcgacgctggacacgctgaaggcgaccaccccgatggccagcatcccgagggcggcccgaataccccggggggggccgacgggcggcgtcatgcggggagggtgacgaggtggccgccgttgccacctcgggcggcgccgccggggcggcgccgttgcccccggcggcgacggcggcaacggcggtcggtgcggccgagccgggcggcggcgggaacgcgtacggcagcggcaggtccggcatgaagctgcgaatgcattggcccccttcgcgtttggccgcatacatggccaggtcggcgtgccgcaacagctggtcgacggtgcaggtggacgcgccggtgcacaccgtgaatccgatgctgggccgcacggtgatcggaatgccgtcgatcaggatggccccggtgaacgcctcgaggatgcggtgcgcggccgcttgggattcgtcgacggaggcctcgatgacggccgcgaactcgtcgccgccgagccgggcgatggtgccgctgtcgcccagcgccgcggtgagccgctcggccacccggaccagcagctcgtcgccggcgggatggcccagggcgtcgttgaccgccttgaagttgtcgaggtccaggcacagcacggcgatgggcgtgccgtcgggatgccggcgcgcgacggcctgttccagccgatgcacgaacagcgcccggtttgccaggccggtcaggttgtcgcggaaggcctcccgcgcgacctccgacagcagattctggttgtcgaccaggaccacgaactgccgcgccagcacggcggccaccaggatcccaacgcggccagcatgggttcgtggatggctttgcccgccgcgtgcccccaccccaccgcggcggccaggatcagcggcaggtagggcagccacagccgggtccggaactcgatctcgtccggcgaccccggcgccggctgctcgtacacgctggccagcccggccagcgccaaggtgcccacgccggccacccgggccaggtcgccgatgtcgtcggtgtggtagctgccgatgccggtgtagaagaccatcgcgatgtcggtgacgctgatcgtggcgatgccacaggccagcaggctgcggctgggccggtcgccgggtcgcgcccgggacagcatcaggatggccgtggtcatcagcacgatgtcgttgaagacctcggccagcgtcgccacctgggtgccggtgtgttcgcgcagctgcgcctcgacgacgaacacccaggagatgacgaacagcgacgtcgcgacgatgaggccgtcgagcagcagccggcgggggctgtgccgggacagctgggacagcagcaccaacgacgtcatggcgccgaccgggaacagcagcaagaccagctcggccgccgccgggtgggcggcgtgttcgaattcggggcggacgtcatagaccgcccagatgatctcgcccaccgcccagccgagcagcgcggtcgtcagcgccaaccagccgtaccggcgccgtccggacgcggcccgggccgcccgcgcggcgcagatcgccgcgacggccaggcacacgaacatgacgaggtcgtcgaccggccgggtgccgtacgggccgcgccacccgcggacggacgagagcagcaccagcagggcggccgtgccgtacccgccggccagcagccagcccacgcgcgcgggcacccccgaccgccgccacggattcaccgcccagcgcttcatcgccgctccagccatcccctagctgtggtaatcgacctcaccacgagttacagggaattaaaccgctgccgacgtgcgcggagtgcggctttgacagggttgggcgcggcgtgcgggcggccgaggcgggctcagtccggctgattggcgtcgatgcgggccagcgccaggcgcaggatctggccggtggcgtcgcggtcgggatcgcggcgcagcagcattcccttggccaccgacagcttgtcgccgttgcggcgcggcaggacgtgcaggtggatgtggaagaccgtctggaaggcggcgctgccgtcgttgatcgcgatgttggtggcgtcggccagctccgtgctgcgggcggcccgggcgatgcgctggcccagggtcaccatcccggccagcgtctccggcggggtgtcggtgaggtcgacgctgtgccgcttcggcagcaccagcgtgtggccgcgggtgaacgggcggatgtcgaggatcgccaggtagtcgtcgtcttcgtagatccggatggccggagcctccccggcgacgatcgcacagaacacgcaggacatgtcgcccacggtactggttggcccgcgaccgcctcgtccccgccggcgccggcccggccgacccgcgggatacgctgcggcggtgaacgatctcgccttcgccggcgcggccgcacaagcgcgcatgctggccaacggtgacctgagcgcgccggagctgctcgaggtgtacctggagcggatcgcgcggctggacagccagctgcgctgctaccgcgtggtgctcgccgaccgggcccggcgcgaggccgcggcggcgcagtcccgcctggacgcgggcgagcggctgccgctgctcggcgtgccggtcgcgatcaaggacgacgtcgacgtcgccggggaggtgaccaccttcggcagcggcgggcacggacccgcggtcagctccgacgccgaggtggtgcgccggctgcgcgcggccggcgccgtcatcatcggcaaaaccaatgtgcccgagctgatgatgatgccctacaccgagtcgctgacgttcggcgcgacgcgtaacccttgggatccgcgacgcacaccgggtggcagcagcggcggcagcgccgcggcggtggcggccgggctggcgccgctggcgttgggatccgacggcggcggctcgatccgcatcccgtcgacctggtgcggcctgttcgggctgaaaccgcaacgggatcgggtgtcgctggaaccccacgacgatgcctggtacggcctgagcgtcaacggcccgatcgcgcggacggtgatcgacgcggccgtgttcctcgacgcgacctccacggtgcccggtccggagggggagttcgtcgcggcggcgacccgcgagcccggccggctgcgaatcgcgttgagcaccaaggttcccaccccgctgccggtgcgggtcggcaagccggagctggcggcggtgcagcaggcgggtgcgttgctgcgcgatctcggccacgacgtcgtcacggccgaccccgagtacccggccgcggcgatcctgggcaactatctgccccgctatctgcgcgggatctgcgacgacgccgactcgctggcccatccggagcggctggagacacgcacccgcaacatggcccggatgggctcgttcttctcggaccgccggatggcggccatccgggccggcgagggcccgctgatcgcgcggattcaggcgatcttcgacgacgtcgacgtcgtggtcacccccggcaccgcggccggcccgtcccgggtgggcgcctatcaacgccgcggcgcggtgtccacactgctgcgggtcgggcagtgcgttccctaccaacagatctggaatctgaccggccaaccggccgcggtggtgccgtgggacttcgacgccgacggcctgccgatgtcggtccagctggtcgggcggccctacgacgaggcgaccctgttgtcgctgtcggcgcagatcgaggccgcgcggccgtgggccctgcgccgcccaccggtctgttaagcggaattccgcagcaccgcccaggcggctagtttggcgcccggcgccatcacgtgcgccggactggtcgacggcagccgctgaaagcaaacgtgatcgggtgccatggccagccgacggtacagctcggcggccttggccccgttgaagtacacccgggtgatcccggggtgttcggcgaagaactcgccgaaaccgttgaccaccaagctgtttggctcgatcgcggagtcggcgctgccggcccggcggcacgcgtgcagcacatcccagagcgcgattcggtggcggcgcagctgcgccagccgccgtgggtagggcgcggcggcgtcgaagccgaacagctcaccggtgatcgaccagaacgcgttgcgcgggttggcgtaatactggcccgtcagcagcgattgcgcgctggggaacgagcccaggatcagcgtcctggcccgctcgtcgacgaccggcgggaagccccgcaacagcggtgtgctcatgacctcacatgatggcctgcccgcgttgtacgttgacgacgtgcacgacggggacgaccgggacatcgaggatctgctcgacggtctgcagggaaccgcgcgcaccgaacgcgccgaactggtgaggtggctgctcgcacagggcatcaccgccgaggagatccgaaccaccaacccgccgctgctgctggccacccggcacctgatcggcgacgacggcacctacgtgtcgacccgggagatcagcgagacctacggcatcgacatggcgttgctgcaacgggtgcagcgcgccatcggcctggtccgggtggacgatcccgacgccgccgtgcacatgcgcgccgacggcgaggccgccgccttcacccagcggttcgtcgacgtgggcctggaccccgaccaggtggtgctggtcgcgcaggtgctcgccgagggtttgtcccgcgcggcggaggtgatgcggtactcggcgctgtcggcgatcatgcgccccggcgccaccgagctcgaaatcgccaaggcctcaaaggctttggtcacccagatcgcgcccctgctcggcccgatgatccagcagatgctgttcatgcagctgcgccacatgatggagaccgaggcggtcaacgccgcggaacgggcggcgggcaaaccgctgccgggcgcccgccagatcaccgtcgcgttcgccgacctggtcggcttcacccgcatcggtgaggcggtctcacccgaagagctggggcagctggccaaccggctggccatcctcgcccgggacgtcacggttcccccggtccgcttcgtcaagaccatcggcgacgcagtgatgttcgtctgccccgagccgcggccgttgctcgatgtggtgctgaagctggtggaggccgtcgacaccgacaacgagttcccccggttgcgcgcgggagtggcctccgggaccgcggtcagccgggccggcgactggttcggcagcccggtcaacgtggccagccgggtcaccgccgtggcccggccgggcacggtgctggtcgccgattcggtctgggacgtcatcggcgacaacggcgagttctccggctcgttcgccggagcgcgccggctcaagggaatcaagaacgaggtcaaactgtttcgcgtccgccgcggcggctgagcgcccggcgcggcaacctgcgcacatgggcaggcccggcgcgactctagggggcgtctgactccgtcttacgcgtgtcctacgcggccggattcctaccccgtgttccggcgcttcgaattggtcgctttccgggcctgcttcgctactcaaaatacgccgtcgaacagcccagatcaacgggttcaccggccccggtatgcagcggtgaccgggccgtgaccggccgtctttcgctgcgggtgaacggccgttccctttgcagctgtaacggtgtgatcatgtaatcatgaaagcacatcacgcacaccggcggtacggccgccccggcggctggcagcaggcccagcagcccgatgccagcgacgctgcggaatggttcgccgggcgtctcccggaacagtggtttgacggcgacccgacggtgatcgtcgaccgcgaggagatcaccgtcatcggaaagctccccgagccggccgacgccgagaaggaggcgagcgaggcccgcgcagccggccgggcatcgcgattccgcgaagagacccgctccgagcgaatgcgcatcgccgacgaagcccaggatcgctacgggcgcaaggtttcctggggtgtcgaggtcggctccaagacgggcaccgagcgaatcctgttcacccacatcgccgtacccgtgatgacccggctcaagcaaccggaacgccaggtgctcgacacgctggtcgacgccggtgtcgcccggtcccgcgccgacgcgctggcgtggtcggtgaagctggtcggtgaacacgccgaggagtggctggctcaactgcgcgacgccatgtccgcggtcgacgacctgcgcgcgcagggccccgacctgtagcgcgaaaagcgctgcactccaagggcatttgcgtgcaggcgaccgcttactcgttgtcgatcttggcgacgatcttgtcggcgatctgatcgccctgatcggtgatgcggtatccgcaggcgttgatgtcgacgatcacgttgttggcaacgctgagcgcccgctggcactcccaaccgtcggcgccctcctgggtgtgcatcagggtgatcttcggcggggcgccctgaacctgcgcgaacgtccaccggtaggtcttgctcttgttggtcacggtcaccgtctggcccgcgcatcctttccacttctgcagcgaggtctgcaggaagctcttggccttgtcggcggacggaaacagcaccacggcctggttgacccagtggtcgtagttgtcgccgggctccgacgacaccagtccgttcaccgccgagtaaccgctgcccgcatacaccggatcctgggtggtgtacagcgcgccctggcagtccggcacggacaccgtcaccgacgagctgtcggtggcggtgatcggtttgcccggctccatcgtcgaggagcccatcaccgcgttgacctcggacgcgctgagcagcagggcgccgagccggtcggaggtcagcggtgcggcctgcgggggctccggtttgggccggatcaccagccagacgcccaccccgcccgcgatgacgacgagcacggcgacgaccgcggcgacgatcggccacacccgccgtttgggcggcggccggccccacggcggcggcccggcgaattgtgctggcgcagcggcccaattggcgttgccgccctggtagtacggcggcccgggctgcccggcggctgggatcgggccgctctccggcgtccagccccggccagcttgtgacgcagcggaaccgggctgccgggtgttgacggcaggcggtggcgccagcaccgtgctggccccggcgtcgcgctgccccgcggcggcagggcggcctcttgactgcgccgcaggatggtggcggcgcggtcctggtcgggggtggacagcgcctccttggcggccagcgccagatcgcccgcgctggcgtagcgatcctcgggctttttggccatgccgcgggcgatcaccgcgtcgaaggccttgggcaccccgggccgtcgcgcactcggcgcgggaatggggtccatcacgtgcgccgagaccagcaccccggcgctgtcggcccgatacggcgcggacccggtcaggcactcgaacagcacgcatgccagcgcgtagatgtcggcccgataggtgacctcggcgtccgaaaaccgttcgggcgccatgtatttccacgtcccgaccgccgtgccgagctgggtgagcttttcatcggtggtggcgctggcgatgccgaagtcgaccaggtaggcgaagtcgtcgcgggtgaccaggatgttttgcggtttgacgtcgcggtgcatcaccccggcggcgtgggcggcatccagcgcggaggcgatctgggtgatgatggcgacggcgcgcggcgggggcagtgggccgaagcgtttgagcacgctgtccaggtcggtgccctcgaccaggcgcatctccagaaacatctggccgtcgatttcgccgtagtcgtgcacgggcaccacgtgcggttcctgcaaacgaccggcggtgcgcgcctcccgcttcatccgctcgcgaaacaccgggtcgctgctgaagctttcgttgaggagtttgaccgccaccgtccactccttgacggtgtgctcggcttcgtaaacctcacccatcccgccgcgcccgagcagccgtttcaggtggtaggggccgaacatcgagcccaccttcgaggaccgctcgtcgctcatcgcgcatcctttcgacccgagaccgacaacgtgacggtaagcgcccgcccgtcgcgccgcacgataacggcaacaattgccgccgcccggtgccgagctaaccggcgtgctgattctcttcggccagccggaaagtgaattcgtgctcgcagatccggatgcggtcgccgtcctgcaggacggcggccgagtggattcgttggtcttgcacgtgcacgccgttggaggatcgcaggtcgttgatgatgtagctggttccggtgtcgacgatgacggcatggtgccggctgaccttgggagagtcgaggacgatgtcgttgtcgtcgaggcgcccgatcgtcgtcgagccgcgcagcggaaacgcccgcccggccgcgtcgtgcagcagggctccggcgttcctgccggacgccagggtgtagtgctcgagcacggtgacggtgaccgcggcggtcgtcatggcattcttcttggcgtccagcggttcctggcgcaggatccggtcgttgagcatgcgcaggttctggcccgggtcgatccccaggtcgtcggcgagtgacttctgcacgcgccgatacgcggccaacgcgtcggactgacggtcggtgaggtagtacgccgtcatcaactgcgcccacagctgttcgcggtagggatgttcgcgggtcagcgattccagttccgtgattacggaaaacgcacggccacaagctatttcggcttccgcttgcgcgatgtgggtcaggatcttctcctccaccagcgaggtggcgaaggtgccgacgaaccggaactccgtcaggtcttcgagcaccgggccgcgccactgcgccaacgcggccgccaggtgcgcgccggcctgttcgaagcggccggaggccgccgcctgcacgccggcggtcttctcggtgatgaaccgaccgagatcgcaacggtcgtcggggatgttgagtcggtagcccggcggcgccgcgaccagcaccgtgcgagggtcgaccccggcgttgctgagcagcttgcgcaggttggatacgtaggagtggaggctggcccgcgcccccgacggcggcgactcgtcccacagtccggtgatcagccgatcgatgccgacggggttgttgcggttcatcagcagcatggccagcaccgcgcgctgcttgggcgtgcccaggggcactaggtcgccgtcgacggtcatctccagcggtccgagcaggccgaactcgagacgcttggccatcatcggggtcgacctgccgtgcggggggtcggggggcagggaggtcacaggggagattgtgacgcccggcggcccgattcgttgcgaatccgaagggcccgcgcgcgaccggctaggagcctgctgaattaggggattttttggggcggggcgtctcgaaccgtctagcggcgtgttgtagtcagaccctgtgggtcgacagaaaagagatcgccccgccgttgttgagcgtggcagcggtcggcggctgaggcaaggccttggtgtgagggcgtgttaggcgatggcccaggtggtgtcggtgcgggtcaggcccatggtgagcagccgacgtaggttcagtgctgcggcgcggtggtgcagccaatggttgtttttggcggttcctcggtagcggaccttgcggttgccgcgagtgagccaggccattgagcgttccaccatgggccggtgttggcggtattcggcttgccaatcggggtcgcgggccgcgacgcgagcagcgcgcaataattgctcgtggatatgaagggtgagtttgcgtccgcgcgtggcggtcgtgcaccgggacgccaacgggcatgagcgacagtatctttcgaaggtgactccgccactgggacggatcggcattccgtgtccagccgggcaggtcacgatgcgggcgtcgaaatcgatgaggaaatcgtcgctggtgaagccacccggaaccggcgggcgtagcggtagcggtttgatcaccgcgacatggccggcgtcggccagtgccgcccgggcggccccggtgccatacgccgaatcgcccaggacccgcaccgggggtgtgttcaccctcgagcaggctcagcccgacgacggcctcgtggttgtccgcgccgctggccttggtcaacgcgcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcgccagtgcccgtcggtgccatcagagccctcgaccggttcaacgtcttgaccggcgatcaacgccaacaacgccaccgcctcagcagcccgcggcgcgagttcctggtcaggcagatagcccagcacccggtgagcatcaccgaccaaaccatccaccagccgatcccgagcggccttatcctcccacgcaatcgcgggtttccccggatcgtcgtaatcatgggcgctgcagtgggcttcgatcaccgctgcagcgccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgtcttgaccgcctcgaagatccggttgggccgatccgaagccgccaaccgacgccgccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggccatcacctcagccggcacgctgggccggccccgctgcgacgggaacaagtccgcgaacatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatccccaaaaccccaggacaactcgtcccgccacgcggaattaattcagcaggctcctagccgggctggccggagaattgcgggcagtaggcctgtgtcgcggcggtgaccaggccggccgcctgcggaggagtcaggttggtctgccggaagacggcgacggtgacggcggtcggggtcttgccggcggacagttcagcgcatacctgatggccctcccgcacggcctcctgcggcgacgggaaagagacgccgaggcttcgcatctgggcgaggaacatctcatcgccggtctgcacggtgcgggcggcggcgggtccggccagtccgacggcggcgagcccgatggcggcggcggtggtgagcacggtgatgatgcggcgcgagaacattgttgccacccctttcagttatcgagtaggacgatcccagcgtcgcgtttgttccttggaaacttctcaataacttcttggtaccgaacgcgattgcttatcgatgcgtagatcgcggtgcccgtcgtcgctgtgtccgcccaccgctatgcctgggtcatcgcgtagtacacactgtgccgggccagcagttcggcgtgagtgccctgttcgacgatcctgcccgcctcgatcaccgcgatgcgatcggcatcgcggatggtcgaaagacggtgcgcgataatgaaactcgtgcgatcccggcgcagttcgcgggtcgcgtgcgcgatcagggcctcggtgcgggtatcgaccgagctggtcgcctcgtccaggatcaacagctgcggacgggccaaaaacgcgcgcgcgatggtgatgagttgccgttcacctgcgctgaggttgccgccgtcgccgctcacccgggtgtggtagccgtccggcagggtctggacgaagcggtcgacgtaggcggccctggcggccgccacgatctcgtcgtcgccggcgccggggcgcccgtagccgatgttttccgcgatcgtcccgtcgaagagccaggtgtcctgcagcaccatgccgattcgcgaccgcagcgcccgccggtccatcgtggcgatgtccacgccgtcgatcgaaatccggccggcgtcaacgtcatagaatcgcatcagcagattcaccagcgtggtcttgccggccccggtggggccgacgatggccaccgtgctgcccggttcggccaccagtgacaggtcgtcgatcacccggatgcccgggcggtaggcgaagctcacgtgcgcgaactccacgcgtccgcttcctcctgcgtcgcggccggcgggccccggcgcggccggcttctcctccggcggttcctcgggctcgtcgagcagggcgaagacgcgttcggcgctggccacccccgactgcagcgtgttgtacattccggccagttggctcagcggtgaattgaattgccgcacatattgaatgaaggcctggatgttgcccagggtgatctgcccggtggccacctgcaggccgcccagcacggcgaccgcgacgtagccgaggttgccgatcaccgccgtcgcgggcgccaccaggccggaaaagaattgggccccgaaactggcccgatagacctcgtcgttgagggcgcggaagcggtcccgggcggcggcccggtggccgaacgtctggaccaccgtgaagccgctgtaggtctcttcgatgtgggcgttgagccgcccgacgctcgtccactgggcgacgaacagacgctgcgaacgccgcacgatcacccgcgtcgccagcagcgacagcggcaccgtcagcagggtgatgccggcgagcagtggtgagatggacagcatcatcgccagcaccgtcagcacggtgagcaccgacgtcagcagctggctgatcgtcatcgacagcgacgactggatgttgtcgatgtcgttggtgacccggctgagtagctcaccgcgctgacgcccgtcgaagtacgccagcggcagccggtgcagcttgtcctcgacggcggaacgcagcgccaccatggtgcgttgcaccgtgcggttgagcagccgcgcctgcatccaaataaacagtgccgaaacgagatagaggagcagcgccagcgccagcgtgcgtgcgaccgcgccgaagtccaccccgcggcccggcaccacgttcatcccggacagcaagtcggcgaaggtgttctgcccgcggctgcgcgccgcggcgaccgcctgcgccttgctgatcccggcgggcagttgccggccgacgacgccgttgaacagcaggtcggtggcgtgccccagaatccgcggaacgatcaccccgatcaccgtgccggcgatgcccagcgtgatcaccgcgatggccgtccgacgttgcggcgcaagctgtttgaccagccgggcggccggaccccagaaatcgcgggaccgcccggcgggagccgggggcgccgggcgggtggtcgtcgtcatggggtgcccccggtgtgacccgacggcactgcccccaccgactgcgagtcggcgaactcggcgtagacggcgcaatcggtgagcagcgcatcgtgcgtgccggcacccgccacctttccgtcgtcgatcaccaccacctgatcggcggtcgcggcgatcgaaacacgttgcgtgacaacgataacggtggcgtcacaggttatctcgcgcagcgcggcacgaacccgagagtcggtgcgggcgtcgagcgcggcgaacgaatcgtcgaacaggtagatggccgggcggcggatgaccgcccgggcgatggcgagtcgttgccgctgcccacccgagaagttgatgccgccctgggcgacccgcatgtgcaggccgtcggggtgggcacccacgaaatcgtcggcggcggccacccgcaacgcctcccacatctgctgctcggtcgcatcggccctgccgtagcgcaggttgtccgcgatcgtcccggagaacaggtagccgcgttgggggaccagaccgatcgccgaccacagccgctcggtgcggtagtcacgcacgtcgatgccgtcgatctggacggctccgccggtgacgtcgtagagccggcagatcaacgagatcagcgtcgacttccccgaaccggtgctgccgacgatcgcggtggtggttccgggtcgcgcggtcagcgaaatgtcttgcagcaccggacggtcggcgccggggtaggtgaacgtcgcacggtccagtcgcacgatcccggtgatcgcccccggcggggacttcgggctggccgggtcggcgacggcggcaccggtggacagcacctcggtgatccgttcggcgcacaccgacgcgcgcggcaacaccaccagtgtcatcgtcgccatcaacaccgccatcaggatctgggtgaagtaggccaggaaggcggtcagcgagccgacctgcatctggccgtgatcgatgcgcagcccgccgaaccagatcagcgcgacgctggacacgttgatggtcagggtggtcaccggcagcatcaacgcctgccaattgcccgccgccagcgcggtattcgacagcgcggcgttggcccggccgaagcggtcccgctcgaaatcctcccgggcgaacgcccgcaccacccgcacgccggacagctggtcgcgcatcacccggttgacgccgtcgatcagggcctgcatgcggcggaagaggggaagcatgtgcgacatcacccagtagttggtcaccgccatcaccgggacgctgataagcagcagccaggtcagggcggcctcttggtggatggccatcacgattccgccgaggcacatgatcggggcggtcaccagcacggtggccgttatctgcaccaggtactgaatctggcgcacgtcgttggtgctgcgcgtcagcagggtgggcgccccgaagcgggcggtctcccgctcggagaaggtgatgacgtgctcgaacatcgccgcgcgcaggtcgcggccgaagcccatcccggtgcgcgagccgaaatagaccgcacccaccgcgcacaacgcctgcactgcggtgaccccgagcatcaccacgccgagccgcacgatggtggaggtgtcgcccttggcgacgccctcgtcgatgatggcggcgttgaccgtcggcagatacagcgacgccagattgctgatgacctgcagcgccatcagcaccgccaccagccgccggtacggctggatgtactggcgcagcagtgccaggagcatggggtaactgtcgcacaccccgcgcccggccggccgcgtcgccgccggatcgtcaccgcgtcaaggctcgtcgccggcggcgccgaaatacctgctcaggcgcgtcggtggttgacccgctgggcggccgctacagtgcatcgtgtggaccagcagcgggcagaacggaagcagggtggcggtgcggcgtaacacgagggcgctggctctcgtcgcgtcagccttgacgatcctgatccccgcgaccgcggcctgctccgactccggcggctccaaacccggggcgacgacgtcgtcggcgccgcagaacggccagggcaaccatgggccgatgttcccgcagtgcggcggcatcagcgaccagacggtcgcggaactgaccaaggtgagcggcctgatcaacaccgcgcgcaactccgtcggatgccagtggctggcgggcggcggaatcctcgggccgcacttctccttctcctggtaccgcggcagcccgatcgggcgcgagcgcaagaccgaggagctctcccgcgccagcgtcgacgacatcaacatcaacggccacagcggcttcatcgccgtcggcaacgagcccaacctgggtgattcgctgtgcgaggtgggcatccagttctccgatgacttcatcgaatggtcgatcagcttcagtcagaagccgttcccgccgccctgcgacatcgccaaggaactggcccggcaatcgattgcgaactcgaaatgatggccatgatgcgtcccggaccgcgccgcagcaccgctcgcgccgcggcgaccgtgttgttcctcgcgctgctggtgctgacgggctgttcccgctcgatcgcgggcaacgcggtcaaggcgggcggcaacgttccccgcaacaacaattcccagcagcagtaccccaatctgctcaaggaatgtgaggtgttgaccagcgacatcctggccaagacggtgggtgcggacccgctcgacatccagagcaccttcgtcggcgcgatctgccggtggcaggccgccaacccggcggggctgatcgacatcacccggttctggttcgagcagggcagcctgtccaacgagcgcaaggtcgccgagttcttgaagtacaagatcgagacccgcaacatcgccgggatcgattcgatcgtgatgcgccccgacgaccccaacggcgcctgcggggtggcgagcgacgccgccggggtggtcgggtggtgggtcaacccgcaggcgcccggcatcgacgcctgcggccaggccatcaagctgatggagctgacgctggcgaccaattcctagcttcaccttggctcggccgatgagcctcagcgcgcaacgacgaagtcggtcagcgtcgccgccccgagttccagctccgtccaccggcacggcaccgcgagcaccgcgatcgccgacgtcggaaacttgttcgagatgcgttcggccgcagcgggattggcgccactgccgccgcccaggccgagcgcaagggccgacatcgtcggctcgtgtccgatgacgagcagcgtgctgacgtcgtcgcccaccgtgttgatctcgtcgatgacgatgcccggggtgctggcgtagagccgctcgctatatcgcaccggcgcctcgatgcgggtgttgcgcagcgtctcccgggtgcgcgtcgcggtggagcacagcacggcatcgatggcgggcgcgccggcgcgcagccagtcgccggccaggccggcctgccggatgccgcgcggcgccagcggccgatcatggtcggcgacgccgtcggggtagtccgacttcgcgtgccgcatcaacagcagggtgcgtcggccggtcacggccaatcagattagacggcggcagggtcgatcaggccgcgtggtcgtcaccctggtcggcttcttgttcgccgtcaacttcgccgtcgtcgtcctcaccctgtaggagtttttcggggtggtggaaggtgttggtgcggggttggtttcggtctaggtggggtggtggaatccattcggtttcccctttggcgtttttgtgggtggtccaggcgccgggttgtagcaggcggtggtggggtccgcaggcgaaggtcagatcgttgatgtcggtggtgtggcaggtggcgtagtcggtgcagtgatgcacttcgctgtagtagccggggatggtgcagccgggggcggtgcagccgcggtctttggcgtataacacgatgcgctgtgcgggtgaggccaggcgtttggtgtgatacagggccagggctttgccctggtcgaaaatcgcgaggtagtggtgggcgtgccgggatagccggatcacatcggacatgggtagcagggtgccgccgccggtcagacgccgtccggcggcggtttcgaggtcggccagggtggtggtgacgatgatggaggccgggagcccgttgtgttggccgaggtttcctgaggcgagcagggcgcgcagcccggccagcagcccatcgtggttgcgctgggccgccgagcgggcatcaccgtcgatggcgtgttgactcggagtgccttccacgcacggactctcatcgagtgggttgcacatgccgggggcggcgagtttggccagcaccgcctcgagggtggcgcgcagctcgggggatagccagccgcggagttcggacatgccgtcggcctgttggttgcccagggtgaggctgcggcggcgggcgcggtcttcgtcgcggtagaggccgtcggggttgaggcaatcggccagcgtgcccgccaacgcggcgagctgttcgggccgataccgggtggcttccctggccaggtcggcttcggcgcgttcccgggttgcctggtcgatccagcccggcaactggtggcagaacttacggatcaccgccacctgctcgagacccaacgacccctcccgttgccgcgcggcggtggccgccagcaacggtggcaacggttcgccggtcaacccgacgcgggggcccaaatcagcggcggtgtgcacccgccgggcggcctcggcgcggctgatcagcgtggcctcggcgatcgcatgcgaaagccggccccccaactccgccggggtggcgtcgcgggccagcgcgttgatcagctggtgttcggcgacgggcaggcgccggcgggctttttcgcagcgccccaatagcgccaggcattcccgcggggtcaagccgtcgaaaccgagcgccgccacgccgtcgagcgcggcatcgagcgcatcgaaggccgcgctgatcgcgtcccgatcgatgatgccgcccgaactcatgcccccgaaactagggcagcccaccgacagaaaaccccgcaatgtgaccacagaaacgaaagtgacataagagatttagtcgggcgcccccgagcgtgccggtggcccacgaccccaaccggcgatcaaggcccgccccatcgagacccggcggattctcccttcgagacctgccgatcgacgtcccgcgtcttgtcggtgcgcagacctaaactcgcgatgccctgataaacacgcacttcgaaagggggtcgccggcatgcgattcctgcacaccgccgactggcaactgggcatgacgcgccacttcctcgccggggatgcccagccccgctactcggcggcccgccgcgacgcggtcgccgggctgggcgcgctcgcggcggaggtcggcgccgagttcgtcgtcgtgtcgggcgacgtgttcgagcacaaccagcttccgccgaaggtggtcgggcagtcactggaagccatgcgcgccatcggaattccggtctatttgctcccgggcaaccacgacccgctggacgcctcgtcggtgtacaccggcgcgctgttcaccgccgaacgtccgcacaacgtgacggtgctcgatcgggccggcgttcaccaggtccgccccgggctgcagctcgtcgcggcgccgtggcggtccaaggtgcccaccaccgacctggtcggcgaggttctcgacggcctgcccgagaccgacgacacccgaatcctcgtcgggcacggcggggttgacgtcctggaccccgatcgggacaaaccctcgctgatccggctcgccaagctcgaggacgcgctgacccgcggcgccgtgcactacgtggcgctgggcgacaagcactcgctgacccaggtcggcagcagcggccgggtgtggtactcgggctcgccggaagtcaccaacttcgacgacgtggaagccgactcgggccatgtgctgatcgtcgacatcgacgagaccgatccgcgccgccccgtctcggtgaccgcccggcgcgtcggatgctggcgattcgtcaccctgcaccggcaggtcgacagcagccgcgacatcgccgacctggacatgaatttggacctgatgaccaacaaggaccgaaccgtggtgcgcctggcgctgaccggttcgctgaccgtcaccgaccgcgccgcgctggacgcctgcctggacaggtatgcgcggttgttcgcccacctgcgcacgtgggacagccacaccgagctggccgtgatcccggccgacggcgaattcagcgacctgggcatcggaggcttcgccgccgcggcggtcgaggagctggtggcgaccgcgcgccaacaggattccgacaccgccgccgacgcgcagggggcgctggcgctgctgttacggctcgccgatcggggcgcggcgtgaagctgcaccggctgaccctgacgaactaccgcggcatcgcgcaccgggaaatcgaattccccgaccacggtgtggtggtggtgtgcggcgccaacgagatcggcaagtcgtcgatgatcgaggccctggatctactgctggaggccaaggaccgctccaccaagaaggaagtcaaacaggtcaagcccacccacagcgacgtgggttccgaggtttcggccgaaatcagttgcggcccataccgattcgtctaccgcaaacggttccacaaaaagtgtgagacggagctgacggtgatcacgccgtaccgcgaacagctgaccggcgacgaagcccacgaacgggtccgggcgatgctggccgagacggtggacagcgacctgtggcatgcccagcgcgtgctgcaggcggcgtcgaccgccgcggtggatctgtcggggtgcgacgcgctgtcccgcgcgctcgacgtcgccgccggcgacagcggcgggctgtgcggcaccgagccgttgctcatcgaacgcatcgacgccgaatacgggcgctatttcaccccgaccggacgcccgacgggggagtgggcagccgcgatcgcccggctggccgacgccgaggtcgccgtcgccgagtgcgcggccgccgtcgccgaggtcgacgagcgggtgtcccgccacgccgcgttgaccgaacaggtggccgacctgtcccagcgccgcatcgccgccggcccgcgagtgacggccgcgcggcaggccgccgaccggatcgccgagctcaccgcccagcgccgggaagcccagctggtcgccgaggccgcggcggccaccaaagccgcggcggcccaggcccactccggccggctacaactgctcgccgacatcgacacccgggccgccgtcgtcacgcagacacatgctcaggtccagcaggccgcggccgaccacgcggcggcccaggccgacgcgcaggcctgcgacaccgcgctgcagcacgccaccgaggccctggccgagctggagcgccgggtgcaggaggcgcagcgcaccgtcgagcggttggccggccgcgaggaggccgaccggttggccgcccggctggacaaaattgatgccatccagcgcgatcgcgagcgcatcagcgccgagctgagcaccatcgcggtcaccgaggagttgctgcgccgcatcgaggacgccgccgccgcggttgaccgcatcggcgaccagttggcgtcgacgtcggcggccgtcgaattcaccgcggtcgccgacattcacctggtgatcggtgaccagcaggtgtccctgccggcggggcagagctggtcgatcaccgccgccgggcccaccgcggtcgaggttcccggtgtgctgaccgcccgcgtcatcgcgggcgcgaccaccctggatgtgcaagcgaaacacgctgcggcgcaacaagaactggccgcagcgctgacggcgggtgccgttgccgaccttgccgccgcccgatccgccgaccagcgtcgccgcgagctgcagggcactcgcgaccagctcggcgccaccctggccggattgtgcggcgacgagccgctcgacgagctgcggtcgcggctggcccggctgcgcgccgagcatccggagcagccggccgagccgacgggtggggccgccgacctcgccgccgcccgcaccgaactcgaagcgctcgcgcaggcccgcgcctgcgcgtcggccgaatgcgacacgcgccgtcaggccgccaccgccgcggccgccaggcttgccgaaaccgcaacggcggcaacggttctgcagaacaggctggacaccctgcgggccgagctggacgcggccaccggtcggctggccgccgagcgcgcgtcggtcggcgacgaggagctggcggcgtcagccgatgcggcgctgcgcgccgagcaggccgccgaacgccgggtcgccgaactcgccgacgccctggccgcggcgtctccggacgccgtcgccgccgaattagccgatgccacacaggaatccgagtcgctgcgggagcgctacgaagaagcggccggcgcgctgcgcgaggtcacgatcgagctgtccgtcttcggcagcgaggggcgccagggcaagctcgacgccgcggaaacggagcgcgagcacgccgccagcgagcacagccaagtcggccgccgggcccgcgccgcccagctgctgcgctcggtcatgacgcggcaccgcgacaccacccggcagcgctacgtcgagccctaccgcgcggaactgcagcggctcggccgtccggtgttcggccccaccttcgaggtcgacatcgacagcgacctgtgcatccgcagccgcaccctcaacggcatcaccgtgccctacgagtccctgtccggcggcgccaaggagcagctgggcatcctggcacggctggccggcgccgcgctggtcgccaaggaagacgccgtcccggtggtggtcgacgacgcgctcggtttcaccgacccggaccggctggccaagatggggcagctgttcgacagcgtgggaagccacgggcaggtgatcgtgctcacctgcagcccggaccggtacgacggcgtcaagggcgcgcaccgcatcgacctcagcgcttagcccgcgcggccgagccgccggccggccccgcctgcagaatgggaccatggcggtccgacccgaatgacgatgaacgcaaagcggcggcgcatgcagcagcggctggcgaaactgcccggtgtgcgcgccgtgcgccggccgatctcgccggacaccgccgacgagttcgacctgtactacgtgcgggccggccgcaagtcccgccacccggtggtcatcatccccggcgggccgggcgtggcgtcggtgcagatgtacaaggggctgcgccggcgcgccgctgcggccggtctcgacgtcatcatgatcgaacaccgcggggtggggatgtcgcgtcacgacgacgccggcgccgacctgccgccggaggcgatgacggtcaatcaggtggtcgacgacgtggcggcggtgctcgacgacgcccgcgtggattcggcggtcgtctacggcgcgtcgtacggcacctacatcgcgtccggcgtgggcgtgcgtcatcccgcccgggtgcacgggatggtgctcgattcgccgctgctgtcccggcacgacattgtgatcgtgcgccgggcgattcgccggctgctgctgcgcggcgacagccccgaaaccgcttcgctggcaccgaaaatgcgcaaacttgtcgacgccggggtgatgaccgcgacggcgacacaggtggtggcgacgatctacggctacggcggggcgcggctgctcgagcggcaactcgacctgctgctggatggccgaaaactgttgtggtggacgctttcccgcttcaccaccctgggcaacctgccgtttcggtatgaagaggacctggtgagccgcatcgcgcttcgcgagctggactatgccgccgaaccggacggtctgccgcttgaccccgccgtggcggaacgcgaagtacgcacgcagacagcggctttcgaggacgagccctatgaccttccggccgagatgccgaacttcgactggcccaccgcggtggtgtccggcggtcgcgacctcatcaccccaccggcggtcgccgagcgcgtcgcgtcgctactgccccatgcggtgctgctgagcctgccggacatggcgcacagcgcgctcgatttccacgaggccgtcgcgctggccagcgccgacgcggtgctgcgcggcgacctggccggactcgccgcccgggcctgcaccctgaacgcgcttccgccacgccccgaggtgcggctgctgtgggccctgatcgcggcggccgccattatcgagggcgcgctgccgatcccggcgccgctgcggcgccggctcagctgcgggtgaacccgatcgcggtgtagttcagatcgcccagacccgcggcgccgaagttcgccagcgtgctgcgtaccgcgacgtcaccgggcgactgcgtcagcggcaggctgaacccttccgcccagatcagcttgtccaggtcgttggccagggcgcgcgccttgtccggatcgagctcttgtagggtgcgttcgatggcggcgtcgatctgcgggctgccgatgttgccgaagttgctctccccgtcggacttgtagatctgggtcagcgccgagagcgggaatgcgtcaccgagccaaccgaattgggccatgtcgaaggcgccgacgttgatgtagttggtgaagaatccgctgcccgcgcgggcgacgagttcgagcctgacgccgatttgggccaggctgtgctgcgcgatctcggcgaactgccggctgccctgggcgtcgtagaagagatcgcggatgaccagctgccgcccgtccttctcgcggaaccggccgtgcagcttccagcccaacgcgtcgagctcccggccggccgcggccggatcgtagggaaccgtcgtgctgttgtcctgatagccctgttgtccggcgacgtagatgtgattgcccagcgccaccgggttgctggtgaggccgtactgcaccaccttggcgatggtctgccgatcgatgcccttggacaccgcgacgcgcagcgcccggtcggccaggatcgagccgggggcgccgttgaaggtgaagtgggaccaggccggggcgggggcgcgccggatcgagatgcccgcggtgtgctcggcgatggtcagctgatcgagggtgccgaccccggtggcgtcgatcgtgttgttctgcagcgccggcagccgtgcggcgtcgtcgagcaccaggtaggtgatgctgtccaggcgcggccgcgtcccccaccatttcgggttgcggctcaacacgatccgctgcgtggtgcgatccagcgacgacacgatgaacgggccggccgacgggccgggcccctcgagctgacccttgttgaacgcctccggcgtggcggtcatgctcttgggcagcagcatgccgttgcccgcgaacatgccgcgccactcggcatacggcttggcgaaggtgacgacggcctgccggtcgtcgacgccgcgggtcaccgaggcgacgcgttcggccccgctggacccggcgatctcgaacgtcttgtcggcgccgctcagcgcgtggatctggctggcgatgtcctcccaggtgatcggggtgccgtccgaccagaccgccttgggattgatcgtgtaggtcaccacttgcggtgcggtgccggtgagttcgacgctggtgaagtagtcggtgtccaccgtggtcgagccgtccgggccgatgacgaaggcccgcggcaaggtggccttcatcatcgccgaaacgtcggcggagtttccgtcgatgtgcaagatgttgaagttgggcgggaagtcggtcagcgcgaggcgcaggttgccgccgtcctgcagggtggccggatcgcgcgggttgatgtcgctggtggtgccgatccgcgcgttctgcccggtttcgggaaccaggttgatggccggtgagcagcccgccaccgccagcacgatcgcggcgaccagcgcggccggccgaaatccgcagcgccccaagccaagcccgctagccacggctgcccggattcggttgtggcaccgcgtccagcagccgccgcgtgtattcgtgttgcgggttgccgaagacctgactgctgtcgccctgctccacgatggatccggcgtacatcactgccacgtcgtgggcgagatgcttgaccaccgaaagatcatgggagacaaacagataggacagttgaaattgcgcttgcaggtccagcagcaggttgatgatcccggcctggatggacacgtcgagcgcggagacgggttcgtcgagcgcgaggatcttcggttgcagcgccagcgctcgcgcgataccgatgcgctgtttctggccgccggagaactccgcggggtagcgggccgcgtcggcccgcggcagccccacagtctcgagcagctcggcgacgcgcgcgttggtgcggtccttgtcgaagccattggcccgcaacggttcggcgagcagctcgaagaccggcagccgcgggtccagcgacgcgaccgggtcctggaagaccacctggatgtcgcgtcgcagcgaccgcctgcccgccgggctcaacgcggcgacgtcggtgcccaacacctcgatggaccccgattgcggcgcaacgagttccaggatctcgtgcagggtggtcgatttgcccgacccggattcgccgacgatgcccagggtgcggccctgtcgcagctggaaactgatccggtccacggctcgcacttcgccggcgctgcggcgtaacacgcccttggtcagccgataggtcttggacagctcgcgcacccgaacgacgacgggcgagtcggccggctcgcccgggtggggttgggtgcgcaccccgtagatgtcggctgcgctgcgcccgtcgacctggtcggtgcggatgcacgccgcccggtgatcggggccgacgggcagcaattccggttcttgtgaacggcattcgtcgatcgccagcgggcagcgcggggcgaacgggcaccccggatccaggccggccagcgacggcggcgcgcccgggatcggcaccaaccgggtgccctgggcggcgtccagtcgcggcaccgagcccaacaggcccacggtgtagggcattcggcggtcccggtacaggctcgccaccgcagccgattcgacgacccgaccggcgtacatcaccagcgcccggtcggcgaactcggcgaccaccccgaggtcgtgcgtgatgatcagcaccccggcgccggtgatgtcgcgggccgtcttgagcacctcgaggatctgcgcctgcacggtgacgtccaacgcggtggtgggctcgtcgcagatcagcaggtcggggtcgttggcgatcgcgatcgcgatgaccacgcgctgtcgctccccgccggacagctcgtgcggaaacgcccgggcgcgtcgctgcggctgcgcaatgcccaccagctcaagcagttccaccgcgcggtcccgggcggccttcctgcccacccgcggctggtggatcgtgatcgcctcggcgatctgatcgccgacggtgtacacgggcgtcagcgccgacatcggatcctggaacaccatgccgaccgcccggccgcgcaaccgcgacatcgcgtcgtcgcccaggcccagcaactcggtgtcgtgcaaccggaccgaaccgcgcaccctggcgtgctcgggcaacagccccatcacggccatcgccgaaaccgacttccccgaacccgattcgcccaccatggcgacgacttcccccggttcgatgcgatagctgacgccgcgcaccgcggtcaccggcgcatcgccggccgggaaggtgacggccaggtcggtcacctgcagcagcgggctcaccggcgaccaccgcgggccggcccgctgccggggtccagcgcgtcgcgcaggccgtcgccggtcaggttggcgcacaccaggatcagcaccaggacgccggcgggaaacaagaacacccacggaaaggtggtcgccgactgggtgccgttggcgatcaacgtccccagcgacacgtccggcggctggacaccgaaacccaggaaactcaaacctgtttcggccaggatggccgaggcgacgttgagcgcggcgtcgatgatcaggatggacgccacattcggcaccacatgcccgacgatgatacgacggctggacacacccatataccttgccgcccggatgaattcgcgctcgcgcaggctcatcgtcatgccccgcaccatgcgcgagctgaccatccagccgaacccggccagcagcaggacgagcatcaggatattggcggagttcttggtgcgcggcgtcacgatggcgatgaggatgaagctgggcaccaccaacagcaggtccaccagccacatcagcacccggtcgcgccagccaccgaaatagccggcgatcgagccgacggtggcggcgatgccggtggagatgaccgcgacgcagacaccgatcagcatcgacttctgcatcccgcgcaggatctgcgccagcaggtcctgacccaacgcgttggtgcccagccagtggcgcgcgttcggcggctgcagcagcgcgtcgaaatcaaggtcctgataggaatacgggagcaccgcgggcagcgtgtagcagccgacgaacaacagcaccaacagcgtcagcgaggccaccgccaaccggttgcggccgaacctgcgcagcacgagcgtgcgccgcgaggcgaagcccgccacttcgtggcccgaaaagccgtgagcgccatcgacattcgcctgggcggtcatgacacccggacccgcggatcaagagcggcgtagaacacgtccgagagcagaccggccagcagcaccaccgcgccggagaacagcgtgatcgccgcgacgatgttggtgtcctgcgtcgcgacgccctgcaccagccattcgcccatgccgtgccagccgaagatcttctccacgaacaccgccccggtgaccagaccggccaccccgtaggcgaacagggtggccagcgggatcagcgcggtgcgcaggccgtgcttgaccagcgcgcgccggcgggtgagccccttggcgcgggcggtgcgaatgaaatcctggccgaggacgtcgagcatcgcgttgcgctgatagcggctgtatcccgccgcggcggccagcgccagggtcagcgacggcagcaccagatgccgcagccggtcgactagcgcggcggccccaccggtcacgcccggcgacgtctcaccggtgtagtcgaaaacctgtacgcccagggcccagttgactcgtagcgcggcgaggatcaacaggctggcgatgacgaaggtcggggtgctcagcaccagcagcgccagcatggtgaccacgcggtcgctgaggcggtactgccgaatggcgccccacgcgccggccgcgatccccgcgacggtgccgatcagcgaaccaatcaccagcagccgcagcgtcactccgacgcggcgccccagcgaggcgcccaccggctgcccggtgacggtcttgccgaagtcgccgcggaccgcgtgtgaagcccagtgcgcgtagcggattgggatcggctcgtccagacccaggctgtgggccttcgcatcgatgacggcctgcgggggccgcgggctgcgctgcaacaggctgtccagcggcttgaacgccaccgaagtcaggcagaacgtcaggaacgacgccagcgccagcaggacgaggtagttgagcaaccggcgcgccagaaagcgagtcatgccccaccacagtgccgcattgggacaggttagccagacgaacgcgaaccttccgatcgtgctgattgccaacggtgaaaatcaggtacccgattgttaagatccgtcgcggcggcagtccgcgtagcaaatttcgaggagactggcatggcggttaccgatgactacctggcccacaatgccgggtacgcgagcagcttcgagggaccactgccgatgccacccagcaaacatgtcgcggtcgtcgcgtgcatggacgcgcggctggacgtgtatcgcatcctcggcctgcgcgagggggaggcccacgtcatccgaaacgccggcggcgtcatcaccgacgacgtggtccgctcactggccatcagccaacggctgctgggaacccgggagatcatcctgatccaccacaccgactgcgggatgctcaccttcaccgacgacgacttcaagcgcggcatccaggaggagaccgggatcaaaccgccctgggcggcggaggcctttgcggatctggccgaggatgtccggcagtcgctgcgccgtatcgaggccaatccgttcgtcaccaagcacgtctcggcccgcggattcgtgttcgacgtcgccacgggcaagctcgacgaggtcaagccctagacccgtgtagtcagcgcgaaaaaacggcccgaacgtcaccgtgggtgcacgctcggccgacaacttgagcgccggccgacacaactcgagcgccggccggctcaccccaccttgtaggtggccagcgccttggccaccagcgtgccctgcgggtcgacgatctcggcctcgcagttgaccagcgaccggccccgccgcagcacccggccgaccccgatcacgtcgctggcccgggccggggccatgaagtccagggccatcgacacagtcaccccccgcagctgcggcggcgcctgggcgccgcaccacgccgccgccatcacggtgagatcggccagcgtggcgatggcgccgccgtgcaccatgtcgccgatcgtcacgttggagggatcccagggcagccgcagccggacctcgtcctcgtccagccgctcggccacgatgccgagcttgacgacgaacggcgactggggcaggaactgggcgatcacgtcgcgaccgctcggggcggcggccgattcggaagcggaagaagtggaagaagtcatccgcccatgttttcgcaccgcgccccgtcggcaaagcaccgcgcccactccggcgtgacggtgacgccgcccgcgccggagttgacagcgccggcgccggctggtctcatagatcgttaagatgctaaatatggtcagttctgccaggttttatctccgaccttgccgaaggaagccatgaccgctgatctgcagacggcgcccgccgccggacagtacgaattgagccatctgcgctcgctggaggcggaggcgatccacatcatccgtgaggtcgccgccgagttcgagcgcccggtactgctgttctccggcggcaaggactcgatcgtcatgctgcacctggcgttgcgggccttccggcccggacggctgccgttcccggtgatgcacgtcgacaccgggcacaacttcgacgaggtgatcgccacccgcgacgagttggtcaagcagcacggcctgcgcttggtggtcgcctcggtgcaggacgacatcgacgccggacgggtggtcgagccgaagcagggacgcaacccgatccagaccgtgaccctgctgcgcgccatccgcgagaacaagttcgacgccgcgttcggcggggcgcgccgcgacgaggagaaggcccgcgccaaggagcgggtgttcagcttccgcgacgagttcgggcagtgggatccgaaggcgcagcggcccgagctgtggaacctctacaacggccggcaccacaagggcgagcacatccgggtgttcccgctgtccaactggaccgaattcgacatctggtcctacatcggcgccgagaacatcgcgctgccgtccatctattacgcccaccggcgcaaggtgtttcgccgcgacggcatgctgctcgcggtcgaccggaacatgcaacccaatcccgacgagccggtgttcgaggcgacggtgcggttccgcaccgtcggggacgtcacctgcaccggctgtgtggaatcgcaggcggccacggtggacgaggtcattgccgagaccgcggtgtcccggctcaccgagcgcggggcgacccgggcggacgaccggatctcggaggccggcatggaagaccgcaagcggcaggggtacttctgatggccgccccaaccacgctattgcgtttggccactgcgggatccgtcgacgacggtaagtccacgctgatcggccggctgctctacgactccaaggccgtgatggaagaccagtgggcggcggtggagcagacctcgaaggaccgcggccacgactacaccgacctggcgctggtcaccgacggcttgcgggccgaacgcgagcagggcatcaccatcgacgtcgcctaccgctacttcgccacgcccaagcggaaattcatcatcgccgacacgcccggccacatccagtacacccgcaacatggtgaccggcgcgtcgaccgcgcagctggtgatcgtgctggtcgatgcgcggcacggcctgctggagcagtcccgccggcacgccttcctggcctcgctgctgggcatccagcacatcgtgctcgcggtcaacaagatggacctgatcggttgggacagagagaaattcgagtccatccgagacgaattccacgccttcgccgcgcgcctggacgtgcacgacgtggccaccatcccgatttcggccctgcacggcgacaacgtggtgaccaagtcggatcagacaccctggtacgaggggccggcgctgctgtcgcacctcgaagaggtgtacatcgccggtgaccgcaacctggtcgacgtgcggttcccggtgcagtacgtgatccgtccgcacacccacgagcatcaggaccaccgcagctacgccggtaccgtcgccagcggcgtgatgcgtcccggcgacgaggtcgtggtgctgccggtcggcaagcgcacccggatcaccgcgatcgagggcccgaacggcccagtgcaagaagcgttcccaccgatggcggtgtcgctgaccctggccgacgagatcgacatctcgcgcggggatctgatcgcgcgcacccacaaccagcccaggatcgcccaggatttcgacgcgacgttgtgctggatggccgacaacacgacgctggaaccgggccgcgactacgtcatcaagcacaccacccgcaccacgcacgcgagggtgaccgggctcgactaccggctcgacgtcaacacgctgcatcgggacaagaccgcgacggcgctgaaactcaatgagctgggccgtatttcgctgcgcacccaggtgcccctgctgctcgacgagtacacccgcaaccccagcaccggctcgttcatcctgatcgacccgcacaccaacggcacggtggccgcgggcatggtgctgcgcgacgcctcggcccaggccgcgagcccgaacacggtgcggcacaagtcatcagcgatcgccgcggcgcggccccgcggcaagacggtgtggttcaccggtctgtccggttccggcaagtcgtcggtggccatgctggtcgagcagaagctgctcgaaaagggtgcgcaggcttatgttctcgacggcgacaaccttcggcacgggctcaacgcggaccttggtttctccatggccgaccgggcggagaacctgcgccggctcgcgcacgtggcggcgctgctggccgattgcggcaacgtcgtgctggttccggcgatcagcccactggccgagcaacgcgaattggcgcgcaaagtgcacgccgacgccggcttcgacttcatcgaggtgttctgcgacaccccgatcgaggaatgcgaaaagcgtgaccccaagggtctgtacgccaaggcgcgggccggcgagatcacccagttcaccggcatcgacagcccatatcagccgccggcgaaccccgacctgcggctcatcccggacggcaccgtcgaggagcaggcgcagcgggtgatcgacctgctcgaatcacgcgggtagcccgccgggtcagccaggctgcatcgaaatcgccgctccgggtggcacaatcctgagggtgcggatgtcagcgaaggcggagtacgccgtgcgggcgatgatccagctcgccacggtgcccgacgggacgctggtcaagaccgacgatctggcccaggcgcagggcattccgccgcaattcctcgtcgacatcctgaccaatctgcgcaccgatcggctggtgcgcagtcatcgcggtcgcgagggggggtacgaattggcccgccccggcaaggacatcagcatcgccgacgtgctgcgctgcatcgatgggccgctggccagcgtccgcgacatcgggctgggcgacctgccctactcggggccgaccgccgcgctcaccgacgtctggcgggcgctgcgggccagcatgcggtcggtgctggaggaaaccaccctggccgacgtcgccaccggaagccttcccaagcatgtcgcgcagctggccgacgactaccgcaagcaggaaagccagcggcacggcaccgcgcgcaccggcgactagttcgccgcgcccgacccgtacgggcgggtgaggatctccatggcgtggccggagggatccaggaagtacaccccgcgcccgccgtcgttgtggttgatctcgccgggacgccgggcgccggggtcggcccagtgttccaggccgcgggcgcggatcttgccgtagatggtgtcgaactcttgctcggagaccaagaacgcgtagtgctggcgcgggatgtccgcgccgtcgggggcgtccgcgtagtccaggctggcgccgtggtcgagttcgacgaccatgaagtggccgaacggctttgggccgggcaggtcgaacaactcggcgagaaactccgcggattcccgtttgtcgcgtgaggcgacgatggtgtggttgaaactgatggtcatggttctgtccagtcaaccaccgcgcggccgcggcgacaacgcgccgggcggctacttcggggcggtcagctccagggcgatgttgtcgggatcgcggaactgcaggatgtaggccgggccgatgtccttgaccggctcgtgagcgacgccaagctcctccaaatgcgctgccgccgcatccaattcgtccctgctgtcgagccggaacgcgatgtggtccaggccggtgcggtcctcgtcgaagcggtcggtggccaccggccgcagccccagcagcgtgccgccgaggtcgtagatgacaccgccgaacaaaaagctcaactgctcacgagtggacgcgtcggcgttgtcgggcacctccagcagcaccggccaaccgaacacgctctcgtagaaccgccgtgaccgctcgatgtcggtcacggtcaggcgcacatgcgcgatggaggtgttggtcagacccattcgccccatggttccactgaagggccgaatgttaaacatgccagaatccccgtcgtgcgggtagcgatgaccatgccggtgatggagccggatctggacgcgacggtgctcgagacctgggcgcgcaccatcgacgagggcccgttctcgtcgctgtgctggggcgagcgcatcgccttcgacaacccggacagcctcacactgctgggggcgttggccgcctggaccgagcgggtccggctgctgaccaccctgatcgtgccgcaactgcacgacccggtgctgctcgccaagggactggcgaccggcgacctgctcagcggagggcggctgagcgtgggcatcggcgtgggcggtcggcaggaggactaccacgccgtcggcgccgaccccgcgacccagacgatgcgcggcatggccgagcgggtggcggtgatgaagcgggtgtgggcgggcgagaagctcaccgaatccgtgttgccggtcgggccggcgccggtgcagcccggcggaccgccgctgttcgtcggcagcatcggacccaagaccattcgcagcgcggccgcctgggccgacgggctggccggcaccacgctggacctcgacgttgccaagcagcgcgagctgttcgacgtgacccgagacgcctgggcgcgggccggcaagcccgcgccccacctgatcacctcgttctggttcgcgttcggctcgccccggaccgcccgcgagcagatccaccgccacctgcggcgctacatgaactggataccggccgactacggcgacgccatggcgccgacgacgggctgggccggtgacgaggacgagctggcagaggtgctgcgcaaattcgccgagatcggggccgacgaggtgcagctgatcccgaccagctcggacgtcggccagctgcgccgtgcggccgacgtcgccgcccggctgtagccgggtccgggcgcgtcggggtgaattgccgggccggcgcggcggcgatttgattggtggcatgacgcagcaggaattgcccgccccgctggccgaactgaccgggctgttgaccgagtgcacgaacaagggcgatttcgtgggggccgcgcgacaggccggtgagctggtcacgctgtgccgggcaacgctgggcgaacgccatcccaccgccctggaactcaaggtgtcgctggccaccctgcagctgcgggcgggcgagtgcgcggtggcctacgaggagttcgagcggttgataccccgacctcgtcgaggtgctcggccccgatcatctgagcaccctgaccgcgcggcacctgttggccagtcgacagcaggccgcgttgtcgtcgctggccgaatggtcgcagctgttcgccgacgaacagcgggtctggggcgccgaccacgagaacaccctggtggcccgcgagaagatcgccgagaagcgttgggagataggcgatttcgtcggcgcgatggccgagggcgagcaggtgctggccgcgcggcgccgggtgctcggcgccgatcacaccgacaccctgggcacgcaactgatgttgtcgatctggcggggccgcgccggcgacgtccccgcggccgtcgccgagctggagccgctgatcggtgagctgcgcgagaagctgggagacgaccacgcgcacgtgctgatggcgcggcacatgttcacgctgtgggcgccggagcgggccggtgtcaccgacgcggtcgcggcatgggaggcactggtcgaggaggagagccgggtgctcggtgacgagcacccggtgaccctggcggcccgccaggagctggccggatggtgcgcccggcgcgacggccaggcgggcggcgccggtgcccaggggtcgctggactggtcggcgtcatgacccgcatctgccgtgccgcggccctcaggtcgtcgccttgtccgcgggccgctcctcgttggtgggctgctggggcggctgccccttgcgcagcgtctccagcagctcgcggtacggacccaccaggtagacggtgtcgccggcccggagccaggcgtcgcggcggggatgcagctcgacgggcgtgtcccgacgagtgatcgcgatgacccgggtctgggtggacatttcgaacatccgcagcccgtcgagctcgctgccggccgccacgtgcatggcgccgaccatgaaggaccgctgcccgaccgagaacgtgcccagcacctgcaggcccatcgcggcgccgatgaaccagggcgccgccaggtcgacggtggaccggacgttttcgaacccgaaccgcttggccaccgcatcgcccagagtgcggtcatagatgcgcagcacgatcggcacgtcgggccggttcacctcgggcatcacccgcggccccaacatctcgcgcagcacgatcccgatctcgatgttgaccatgtcgtcctgggtcagcaccgcgacggcccgggcccggtcgacccgggccgactccagcgtctggcgcagcgtcgcatccccgaagatcaccggcacgtcgagttcggccgcggtggacaggaaccggttgttctcgtcgcgctcgatcaccgcgacgtcgtaaccggcggcggtcaggtcggcgacgacgcggctgccgaacgatcccagcccgaccacaatgatgtggttgcgcagatggcgtgcccgccgcagcccggccgactgcagaaagcgccgcgacagcagcaggtccgccaggaacgcgacgagcagcgcggtggtcgtcacgcccgcgaacatcaggcccacggcgaagattcgcagccaggcggactggtgggcgaaggtgaactcgccgtagcccaccgtggtgatggtctcggcggtgaagtacagggcgtccagccaggacagccgcggcttggtgtaggagaagtgcacgatgaccgtggacaccagcagcagggtgagtgcgagcaggatcgcggggaacagcatcgggttgacgtcgtcgcgcatggcgcgggcggcgtccaacacccgccgcagccacgtctggcgagaacgggtcgcggggggccgcggtgttctgatgccgcgcgcggccagttcgtcggcgctgccgatcatggcggtccagtcgccggcgcgcacgcggtggtcccggccgggacagggcaccacctcgccgggggtggcgccgtcgttgccgtggatcaccgccaccggcgccaggtcgccgtagatctcccgaagcgtcgcgtcgcggggtgcctcggcccccgacaccaagaagtcgatgccggccgcccggaccgggtgggtgctgctcgacaagcaggcctcgacgaccgagggggcggcgaggtcggcgacgtcgaggatggcgccggggccgttgtcggcggccaccgccccgcgcagcacgtcgttgcccaaccgggcgaccacccgcacgtgcgggttggttttccttgccagcaaggcgatttcgagattcttggcgtcgtcgcgcccggcgcacacgatggcgctggcgcgggcgaggtcggcgccggcgagttcctcgctgggcagcttgacgatggtggcgcccgcgcggttcagttcctcggcgatggtggtcgccagcacgtcgtcaccgctgacgatgatgtggcggcgcggactcatccggggtgagtcgtcacgcataaccccacctcttgatgacattggcgctcacggtgttgctacgactatcgggcaccatgccgattgacgccagtgcgacgcggtaaggcggcgctagaggacctggacgtcggtcggggaccagaacgcgcgcatcgccgtgatcttggcgtcctcgtcgaacgacatcgtcgagatgggcgagatgcgggtgcgggtgtcgccggcgtcgagcgtgaggtaccacaggaaggcggcttcgctgccggagacccgcaattcggcgagttcggtgtccttcttggcgtcctggaatcccgcatagaaggcccggatcgcgtcgtgcccgcggcgaatgtcggcgccgatcggatcctcgatggtggcgtcggccgcgtacagggtcacgatgtcgtcggcggtaccggtggcgacgagcgccaggtagcgattcacggtgtcggtgatggcttctgcggacggcatgaatcgggacgctactcctggccgtgtcgggtgtggtgttcgtcgcgatactgggcggcgtgactttcatcgaacgcctcgccagccgggagatctaccgcaacccgtggatggtgttgcgcgaggacgacatccgccgcccggacggcagcgcgggcatctacagcgtggtcgacaagccttcgtacgcgctggtgatgccctacgacgggcggcgtttcgggttggtggagcagtttcgctacccgatcggggagcggcgctgggagttcccccagggcaccgctccggagttggccgacgccgatcccgtcgagctggcccggcgtgagctgcgcgaggaaaccggattgcgcgcaacgacgttcgagccgctgggccggctcgacgtggccccggggatgagcagtcagcgcggctgggtgttcctggccaccgggatcgtcgagggtgaagccgaccgcgagcacgaggagcaggacatgcgcagcgcctggttctcccgcgacgacgtcgagcagatgatccggacgggcgtcatcgccgacgcgcagtcgatcgccgcgtacggcctgttcctgttgcgcccggaatcaaccggcgcgcccgtgacggatcaggggcagtagttggattccgcggcgctgacgatggccgtggcgtctgcgtagttgaaggaactgttcaggccggaatgcacatcggcggccagctcgtccggggttttgcccgcggcgcggtcggagcagattgcgtggcccagctgaatcagcgtggtgtcgccgcccggctgccaggcgacgccgatcttcttcagttgggcgaggtacccgtcgtcgtcggcgacggcgatcccgctacctacggtcaatgccgcagcaacgacggccggaatgcataacatgcgtagcccgcaaacagacatgatgcgtggctccttctttcggtggggtgcaaccggctcagtatgcgggctatgacgccgggttgcgcgcggaacggcgcaaacggcgcaaacgcattcatgcccgtcgagcggcgccgtcagcaaggcgagcgttcggtggtggcaatcccgttgccgcgcaacggctcggccgttcagtccggcggcgtcggggtcatcgacgcgatgtaataggtctcgtgcccgctcgggtaaccgccgccgtcggtggcgatgtggacatggtcgtagtggtcggcggtttcggagcccaggtccgccatccagttgcccccgccgacgcccggatagatcttctgccgccagatcacgtgattgattccccagcgtttggcgttcgccagggcgtagccggcgatctggttgccgagctcgatgccttcgggggtgtggtagttcgggatcatcacgtcgatcgccagcccgttggggtgccacggcaacgggtcttcccgatacccgtagatggtcgtgatctgggggaacagcacgctgatggcgcgggccgcccagatggtcttgacttgcagccggtcctcggagcccacgctgtgcggcagtgcgagctggaattgctgccccgcggacggggcgggtggtgccagggccgtcagcgattccacctcggcaggactggcggtgcgcggtgcgccggccggcggggggttcgcggcggcgctggaggcggtggcgttgggggtgggcgccgccgccggcggcgcggggcagcagcgcggcttggtgccctgggcgtggatcatggcggcggagatgacgagggaggccgcgaccgccagccatcggccggcgcccttcgtgaccacccgcacgcccacgaccagcagcttaacgccgcctgtgacgcctgtggctcatttttcgacagcacgccccggtcgggccaaaacgcccctcggcgccgtccggcgagtcacactgaggccatgtccgggcgatcgttcgacgatgcgaatgcttttcaccggttgatgcgccgcttcgcgtccacgaccgccggcgtggcgctgctgcgcccgacggcgcataacctcgaccgcctcgtcgctaaggccaccggcgggcggagcagcttcgccgggttggcaaccggcatcccggtgatcatgctcaccacgaccggcgccaaatccggtgagccgcgcaccgtccccgtgtacgggattccgcatcccgagggcctggccctgatcgcgtccaacttcggcggcgccaagcatccggcctggtatttcaacctcaaggcccacccggaagcgacggtcacggtcgggcgcgacagctggcctgccaccgcacggctggccacgcccgacgagcgcgaccagatctgggccaaaggtgtcgagctgtatccaggttggcgaaaatacgaggtgcgggccggcgatcgccatatcgaggcgttcatcctgagccgggcgccggcctaatccctcacgggcgcttcgcgtttggtaggccgccgccgacgctggtttcgtatggctatgcacacgtcccgacaacaatgactgccgcagaaatctccagggctaccacggtcaccgcggtgttggttcagtgcgcggaaccgctgcgcttattgacattgccggcaccaccgtcaagcgctttcgcggtgaacgcaatcgtccacaggagaacgacgtaagcgagcgcgtagctcggcaccatgacccacaacgacttcccgcccatgaacagcccggctaggccgctcacggtgtcgcctacgaatcccgataccgccactcccgccatgatggcgatgtaggcgtgctcccgcttgcgcgtgaccttgctggatcttcgttgagtgatgtaccagatcccaacggcgacaacgacgatcgccgaggcgatgaatcccgccacgatccacaccggcaggggcttgctgggggctatgtgggctgacttgaacacaacgtcaacggcgatcatcgcagcgatgtacaccggcaacagaaggaccgcgcgcttcaggttgatcacggcttcggcaaccccggtaccggaatgtcagcgcattccgctgcgccctcgacggctgactttacgggcgcttcgagaaggcccttaacgaacccgccgacgaaacccgcgagccccatcgcggcgggtctcgctggaagtgaagtgtttagcgtggggtgccgctgcggtcatctgcgttgccagcgcgactatccagcgctttcgacgtccacgctatcgcccacaataagacgacgtatgagagtgcatagcttggcgccatggcccacaccgacctgccgcctaaaagaagtgatgcaatgctacccagtacgtcgccggcgaaaagggacgccattacgccgacgaggagcgctatgtaagcgtgctcgcgtttctgtgaaatcttgccgctggcccgttgagtgaagtaccagatccctgcggcaactacggctattgcagaggcaataaaaccgacgactatccagactggaacagacttgctggggttgacgcgagttgaatggaacaccatgtcgacggcagtcagcgcgacgacatacagcggcagaatgagcaccgcccgtttgatgttgatcacttcatccaccccggtatcggtacgtcggcgcattcggctgtgccttctagcgccgctttgacgggggcttcctctacacccttcgcgaacccgccgacaaagccgaggacggccccgggcaacgcccctgcgccggcgaactcgggagtggctattccgccacctgccgcaccgacgatcgcacccttgatgcctgtctcgaatccgcctttgaccatatccttgccgacgttagctttcacctgaccccctacgcactgcccgaagctcggttgaggcggcacggtaggcatcggtcctggcgccggctgaggaccggggtctggtcgcggaccgaatgccggcataggtgtggcagccggctgcgctggctggccgggtgacgtcagagcttgcttgtactggtctaagaagctgggctgctgcggtggctgcggagccccaggctggggttgtggttggggttgtgggccgccgtcctgcttgaagtcgacaaggcgcaccccgttgcggttcgagccaggtgtcgtgcggtcggcggcggctgcgccgtgattggagtttggactcgaggctggcgcaaagccgctgccgccgagaccggcagtagcggcggtgagctgagcggcgaccttggtgtcggccccgtcgagttgttcggcgcgcaaacggatgtcagcggcgaacgcttcggcctcagcttggcgcgcgggccgttctgccgggctggtgctgcgggtgtcggtcactgacaagtcttctccgacagtgaatcccgcgttctgggcgtcttcgacgccgaacaggacacgccgttgggccgcgctgatgtcgctggcgccgttacgggctattccagcggcctgccgcaataggtcggccttggcgctgacgacggacagatcggcctgggtgcgttctcgcagtgcgtcaccgccagcaccacgccacgcgatggattgcgcctggttgcgcatcgtcaagaagccgtcttcccagcggtcggcggtttgcgtccaatagccggcagcctcgatgaggtgctcggtggaccacgccaggatctgcgagagtgtggcgggcatcagaccaccctcacgtttgtcacgtcattcatcgcggccgccgatgtggcctcctggctgaggtatccgccggatgccgtggtcaccccgccgaccgtttcctgcgtgcgcgctacgaatgacgccgcagtagcgccgatcgccgcgttgagggcattcacggccgccgtcgtggcctcgaatgacggccccggcgacggcggcgccccaatgaactgggaactaagcgcctgccactgggccgctgtagcgactagctcggcgggcacgacctgcaatgaatcttgccccataaccccatgattttaggcggcgcactgatcgatcgctattgaccagccgacatgcaatgcccccggccgtggtgcccccggcaggattcgaacctgcggccttctgctccggaggcagacgctctatcccctgagctacgggggcgcgacaacgttgttgttgcaccaatgggccccgacagcctaacgcatccggatgaccgcttcgtcaccgcaatggattcggggcgcgggcacctcagccaataggatggacgctcgtgacccccgctgacctcgccgagctgctcagaaacaccgccgccgcggtgctggccgagcgtgggctggacgcggccgcgttgccggcgacggtcgtcgtcgagcgcccccgcaaccccgagcacggcgactacgccagcaacctcgcgctgcagctgggcaaaaaggtcggcgccaatccccgcgagctggccggatggctggccgccgcgctggccgaaaccgacggcatcgcctcggcggaggtggccggcccgggcttcatcaacctgcgcctcgaggcgtcggcgcaggccgtcgtcgtcaccaacgtgctcgacgccggcgaccgctacggccactccgacgcgcaatccacccacaacatcaacctggaattcgtctcggccaaccccaccgggccgatccacatcggcggcacccgctgggccgccgtcggcgacgcgctgggccggctgctgtccacccagggcgccggcgtggtgcgcgaatactatttcaacgaccacggcgcccagatcgaccggttcgccagctcgctgatcgccgccgccaagggcgagccgacgcctgaagacggctacgccggcagctacatcaacgacatcgccgcccaggtgctgcgccaggcgcccgacgcgctgagcctgcccgagccgcagctgcgcgagaccttccgcgccatcggcgtcgacctgatgttcacccacatcaaagagtcgctgcacgagttcggcaccgacttcgacgtgtacacccacgaagactcgatgcacaccagcggccgggtcgaccaggccatcgcccggctgcgcgaaaccggcaacatctacgagaaggacggcgcaacgtggttgcgcaccagtgcatttggtgacgacaaagaccgcgtggtgatcaagagcgacggcaagcccgcctacatcgccggcgacatcgcctactacttggacaagcggcagcgcggcttcgacctgtgcatctacatgctgggcgccgaccaccacggctacatcgcccggctcaaggcggtcgccgccgcgttcggcgacgacccggccaccgtcgaggtgctcatcgggcagatggtcaacctggtccgcgacggccagccggtccggatgagcaaacgggcgggaaccgtgatcacgctcgacgatctggtcgaggcgatcggcgtcgacgcggcgcgctacagcctgattcgctcctcggtggacaccccgatcgacatcgacctggcgctgtggtcctcggcgtcgaacgaaaacccggtctactacgtgcaatacgcgcacgctcggctgtccgcgctggcccgtaatgccgccgaactgggcctcatccccgacaccgcgcacttggaactgctcagccacgacaaggaggggacgctgctgcgcaccctcggcgaattcccgcgggtgctcaaaaccgcggcgtcgctgcgcgagccgcaccgggtgtgccggtatctggaagacctggccggtgactaccaccggttctacgactcctgccgggtgctgccgcagggcgacgagcagcccaccgatctgcacaccgcccggctggcgctgtgccaggcgacccggcaggtgatcgccaacgggctggcgatactgggcgtgaccgctccggagcgaatgtgaacgtccaccccgccggtcctcggcatgccgaagagacccgccaccccgaaagcccgccgcgcccgcagtctcccgaggagctgttgctgctcgcgccgaatgtgtggcctcgcaacgcaactcgcaacgaggccggcgtcgcgaccatcgccggggtcgcggtgaccgagctggcccgcgagtacggcaccccgctgttcgtcgtcgacgaggacgactttcggtcccgctgccgcgagatcgcgtcggccttcggcggcggcaacaacgtgcactatgccgccaaggccttcctgtgcagcgaggtggcccgctggatcgacgaggaaggcctgtcactcgacgtgtgcaccggcggggaactggccgtcgccctgcacgccgacttccctccggagcgaatcaccttccacggcaacaacaaatctgtcgcggagctgacggccgcggtcaaagccggtgtggggcatgtcgttttggactcgatgaccgagatcgagcggctggacgccatcgcggccgacgcgggcatcgtccaggacgtcttcgtgcgtctcaccgtcggtgtggaggcccacacccacgagttcatctccaccgcgcacgaggaccagaagttcgggctgtccgtggccagcggtgcggcgctggccgccgtcggccgggttttcgacaccgaacacctgcggctggtcggcctgcacagccacatcggttcgcagatcttcgacgtcgccggcttcgaactcgccgcgcgccgcgtcatcggcttgctgcacgacgcggtcgagcagttcggcgtcgagaaaacagcgcagatagccaccgtggatctcggtgggggacttggcatttcgtacctagccgcggacgatccgccgccgatgggtgagctggcgggcaagctgagcgcgatcgtgcagcacgagtccgcggcggtggggctgccgacaccgcggctggtggtcgagccgggacgggccatcgctggccccggcacgatcaccctctacgaggtgggcaccgtcaaggacgtcgacgtgagcgccaccgcgcaccggcgctacgtgagcgtggacggcggcatgagcgacaacatccgcaccgcgctgtatgacgcccagtacgacgcccggctggtctcccgggtcagcgatgcacccgccgagttggcccgggtcgtcggaaagcattgcgagagcggcgatatcgtggttcgagacacctgggtccccggcgatctgaggcccggcgacctgatcggggtggccgccaccggcgcctactgttattcgctgtcgagtcggtacaacatggtctgccgcccggccgtcgtcgcggtgcgtgacggccgcgcgcgtctggtgctgcgccgcgagacggtcgacgatctactgagtctggaagtgaggtgagctgtgccccgtgacgaaaagccggtcggtgtagcggtactcgggttgggcaacgtcggcagcgaagtcgtccgcatcatcgaggacagcgccggtgacctggcggcccgcatcggtgcgcccctggtgcttcggggcgtcggggtgcgccgcgtcgccgacgaccgcggtgttccggtcgagctgctcaccgacgacatcgaaggactcgccgcgcgcgacgacgtcgacatcgtcgtggagttgatggggccggtggaaccgtcccgcaaggccatcctgtgcgcgctcgagcatggcaagtcggtcgtcacggccaacaaggcgctgctgtccacctccaccggcgaattggcacaggccgccgaaagcgcgcacgtggacctgcatttcgaggccgccgtggccggcgccatcccggtgatccggccgctgacccagtcgttggcgggtgacacggtgctgcgggtcgccggcatcgtcaacggcaccaccaactacatcttgtccgcgatggacagcaccggcgccgactacgacaccgcgctggccgaagccagcgacctgggctacgccgaggccgaccccaccgccgacgtcgaggggtacgacgccgcggccaaggccgcgattctcgcgtcgatcgcgttccacacccgggtgaccgccgacgacgtctaccgggagggcatcaccaagatcaccccggccgacttcgcctccgcccgcgccctgggctgcaccatcaaactgttgtccatctgcgaacgcatcaccggcgacgatggccaggaacgggtttcggcgcgcgtctacccggcgctggtgccgctgtcccatccgctggccacggtcaacggcgccttcaacgcggtggtggtcgaggccagggcctccggccggctgatgttctacggccagggcgccggtggagcgccgacggcgtccgcggtggccggtgacctggtgatggccgcgcgaaaccgggtgctgggcagccgcggcccgcgggagtccaagtacgcccaactcccggtcgcgccaatgggtttcatctccacccgctactacgtgagcatgaacgtggccgacaagccgggtgtgttgtcgtcggtggcggctgaattcgccaagcgcgaggtgagcatcgccgaggtccgtcaggagggcgtcgccgacgagggcggccgccgggtgggcgcccgcatcgtcgtggtcacccacaccgccaccgatgccgcgctttccgaaaccgtgcatgcgctcgccgatttggacgtcgtgcagagcgtgacgagcgtgctgcgactggaagggaccagcctatgagcgcccagcgcaccgccgtccatcagccctggcccggcctcatcgaggcctaccgagaccggctgccggtgggcgacgactggaccccggtgaccctgctcgagggcggcaccccgctgatcccggcccgccggctctcggaaaagaccggctgcacagtccatctcaaggtcgagggcctcaaccccaccggctccttcaaggaccgcggcatgacgatggcggtcaccgacgcgctggcgcgcggccagcaggcggtgctgtgtgcctccaccggcaacacctcggcgtcggcggcggcctatgcggcccgtgccggcatcacctgcgcggtgctgatcccgcagggcaagatcgcgatgggcaagctcgcgcaggcggtcatgcacggcgccaagatcattcagatcgacggcaacttcgacgactgcctggaactggcccgcaagatggccgccgacttcccgacgatctcgttggtcaattcggtcaacccggtgcgcatcgagggtcagaagaccgcggcgttcgagatcgtcgatgtgctgggcgccgcgcctgacgtgcacgcgcttccggtcggcaacgccggcaacatcaccgcgtactggaagggatacaccgagtatcaccacgagggcctgatcgagaagctgccccgcatgctcggcacccaggccgccggggcggccccgctcgtgcacggcgagccggtcaaaaaccccgagaccatcgcgaccgcgatccgcatcggcgcgccggcatcgtggaccgcggccgtcgacgcgcagcagcaatcccacggccgcttcctggcggccaccgacgacgagatcctggccgcctatcatctggtcgccgagtccgagggcgtgttcgtcgaacccgcgtcggccgccagcatcgcgggactgctgaaggcggtcgaggacggctgggtggcgcgcgggtcgacggtggtgtgcacggtgaccggcaacggcctgaaggatccggacaccgcgctgcgggacatgccggccgtgacgccgctgccggtcgacccggtcctggtggtcgagaagctcgggctggcctgacgaatgggcgcgctcgcaacgaaaggctgttggtgacctccatgctgcccgccgggctggtggcctccgccgtcgtgtcggcgtccagtgccaatctcggtcccggcttcgacagcatcggcctggcactgagcctcatcgacgagatcaccgtcgagacaaccgattccggcctggtagtgcaggtcgagggcgagggcgccgaccaggtgccgctcggcccggaacacctggtggtgcgcgccgtggagtgcggcctgcgcgccgtcggcgtccgcgcggcgggcctggtggtgcgctgccgcaacgccatcccgcactcccgtggcctgggctcgtccgccgcggcggtagtcggcggcctcgcagcggcgaacggccttgtcgcacaagcgaattgccaaccgctgagtgatgctgcgctgatccagctgtcctcggagttcgaggggcatccggacaacgccgcggccgccgtgtttggtggcgcgatcgtttcgtggatcgaccgcggcggacagcacccccggtacgcggcggcgccgctgcggctgcaccccgatatccacctgtactgcgcgattccccaggaacgctcgctgaccgcggagacccgggtgctgctgcccgcgcaggtcagccacgaggacgcacgcttcaacgtgagccgggccgcgttgctggtggtcgcgctcaccgaacgcccggatctgctgatggcggccaccgaggacgtgctgcatcagccgcagcgggcgccggccatgcccgcctcggcggaatatttgcggctgctgcggcgtcataacgtggcagcgacgctttccggggccggtccctcgttgatcgcactgaccacagcgtcggcgttgcccccggaagtgatggagtacggggcggcgaacggattcaccctcgccgaaatgaccgccggcgaaggagttcgctggagcccgggagtcaccgtcgtcggttgatccacagcgtggccggagggtttgcttgcttccggcagggatgggggctatcctcggagccgtccagcaatcgcagcatctgcatctgcatacatactgccttgccgctaggacaacaccaattcttcttgtggacgaggttcgccgtttactccgccgatccaggcgatcaccgttgcaaagtcgatgattgggcgcactcggcaatttggctgaatgcaacgaaccccctgtatgagctgatcagcgggggaagaaaggaaatccgtgactgatacggacctgttcacggctggcgaaaacactgacgccaatcaactctctactgccgtgaccacagacaccccagacgcgaagacgcatgcgccggtcggtgccctgaccaccatggtgctgcccgagctgcgcgcgctggctaaccaggtcggcgtcaaggggacgtcgggcatgcgtaagaacgaactgatcgccgcgatcaaggaagtccgggggcaggccaacggcgccgcgcccgctgagcaggccaacggcgccgagccggccgaggacagcggcaagcccgacgccaaggacgccaaggacgacaccacgcccgacaccaaggacgccaacgaccacaccggcgctcaaagcgccgccgaggcgccggccccgagcgagcagaacggcgccaccgccgaggcgccgcgccgcgagcgacgcagcgcgtcccgcgacgcgggagcggccggccggggcagcgacgacgccgaccgcgagaccgacggccgcgagcaaagcaagcaggacagccgcgagcaaagcaagcaggacggcggcgaccaggaccagcagagctccggtggccagcaggggcgcggctccaaccagcaggacgacgacggcgagggacgtcagggccggcggggacgccgcttccgtgaccgccggcgccgcggcgaacggtccggcgagggcggcgacgccgaactgcgcgaggacgacgtcgtccagccggtggccggcattctcgacgtgctcgacaactacgccttcgtgcgcacctccggctacctggccggcccgcacgacgtctacgtgtcgatgaacatggtgcgcaagaacggccttcgccgcggtgacgcggtgaccggtgcggtccgggtgcccaaggacggcgagcagcccaaccagcggcagaagttcaacccgttggtgcgcctggacagtgtcaacggcggctccgtcgaggacgccaagaagcgtcccgaattcggcaagctgacgccgctgtaccccaaccagcggctgcgcctggagaccacgccggaccggctgaccacccgggtcatcgacctgatcatgccgatcggcaagggccagcgcgcgctgatcgtgtcgccgcccaaggcgggtaagacgaccatcctgcaggacatcgccaacgcgatcaccaagaacaacccggaatgccacctcatggtcgtgctcgtcgacgagcggcccgaggaggtcaccgacatgcagcgctcggtcaagggcgaggtcatcgcctcgacgttcgaccggccgccgtccgaccacacctcggtcgccgagctggccatcgagcgcgccaagcgcctcgtcgagcagggcaaggacgtcgtcgtgctgctggactcgatcacccggctgggccgcgcctacaacaacgcgtcgcccgcctcgggccgcatcctgtccggtggtgtggactccaccgcgctctacccgcccaagcggttcctgggcgccgcccgcaacatcgaggaaggcggctcgctgaccatcatcgccaccgccatggtcgagaccggatccaccggtgacaccgtcatcttcgaggagttcaagggcaccggtaacgccgagctcaagctggaccgcaagatcgccgagcggcgggtcttcccggcggtcgacgttaacccctcgggtacccgcaaggacgagctgctgctgtcgccggacgagttcggcatcgtgcacaagctgcgccgggtgctgtccggcctggattcgcaccaggccatcgacctgctgatgagccagctgcgcaagaccaagaacaactacgagttcctggtccaggtgtccaagaccacgcccggggcgatggacaacgactagccgcgcgacgcccggcgggaatgccccgacgcatcccactgttttgggcgggtagcggttgacctggcataatcgacgcgcgacgagatcgaagaggaatcatgaaagctgacattcaccccacctacgcggagaccacggtgctctgtgggtgcggcaacacgttccagacccgcagcaccaaggacggtggccgcatcgtcgtcgaggtgtgctcgcagtgccacccgttctacaccggcaagcagaagatcctggacagcggcggccgggtggcccgtttcgagaagcgctacggcaagcgcaaggccggcgccgagaaagccgaaagcgccgacaaatagctcggttcccgacgcccgaactgtgcgcgcagtcgcacaggccgggcgtcggttcacgtttgaggtcgtggcgcggggcagggcaggaggtgtgagatgacgcagccggttcagaccatcgacgtgctgctggccgaacacgccgacctggaacgccggctgtccgaccccgacctgcacagcaatcccgacgaggcccgcaaggccgggcggcggttcgcccggctcgccccgatcgtcggcacctaccgcaagctgatggccgcccgcgaggacctcgagaccgcgcgcgaacttgccgccgacgacgattcgttcaccgccgaggtcgccgacctggaatcccgggtggcccagttggacacccagctgaccgacatgctggccccgcgcgacccgcacgacgccgacgacatcgtgctcgaggtcaaatccggcgaaggcggcgaagagtcggcgttgttcgccgccgacctggcccggatgtacatccgctacgccgagcggcacggctggacggtcacggtgctggacgagatcacctcggacctgggcggttacaaggacgcgacgctgtccatccgcagcaagggcgacagcgccgacggggtgtggtcgcggatgaagttcgagggcggggtgcaccgggtgcagcgcgtcccggtcacggaatcccaaggccgcgtgcacacttcggcggcgggtgtgctcgtctatcccgaacccgaagaggtcgccgaggtgcagatcgacgagtccgatctgcgcatcgatgtgttccgctcgtcgggcaagggcgggcagggcgtcaacaccacggactccgcggtgcggatcacccacctgcccaccggcgtcgtggtcacctgccagaacgagcgctcgcagctgcagaacaaggcccgcgcgctgcaggtgctggcggcccggctgcaggccatggccgaggagcaggcctcggccgaggcgtcggccgatcgggccagccagattcgcaccgtcgaccgcagcgaacgcattcgcacctacaactttccggagaaccggatcaccgaccaccgcatcggcttcaaggcgcacaacctcgaccaggtgctcgacggcgacctggacgcgttgttcgacgcgctggccgccgccgacaagcagtcgcggttacagcaggcatgacctcccggcgacgatgcacacgatgagcagcgagacgatccggctcagcctgcggcgcgcgatcgacgacgcgacggccaccctcgccgaagccggaatcgcttccgcgcgttgggatgccgagcagctggccgcgcacctggcgggcgtcgaccgcggccggctgggcttgctcgagccgccgggtcaagagttcttccagcggtaccgcgacgcggtgtcggcccgcgcccggcgggtgccgttgcagcatttgttggggacggcggccttcggtccggtccttttgcacgtcggacccggggtcttcgtcccgcgtcccgaaaccgaggcgctgctggaatgggccaccgcgcaacaacttccaccgcggcccgtcatcgtggacctgtgcaccgggtcgggcgccctggcggtagcgctggctcaccattgcgccggccggggcctaccggcgcgcatcgtcggcgtcgacaactccgatgcggccctggaatatgcgcgccgcaatgccgcgggcacgacggtcgagctggtgcgcgccgacgtcatcgagctggcccgtgtgcccggctcggcgcccgacctggacgggcgggtggatctggtcgtggccaacccgccctatgttcccgacggtgccgtgctggaacccgaagtcgcccagcacgatccgcaccacgcggtgttcggcgggcccgacggcctggcggtgatcgcccccatcgtcgaactggccggccggtggctgcggccgggcggactgatcggcatcgagcacgacgacaccacctcgcaccagaccgtcgaattgttcgaccgcaccgggcttttcgacgacgtgcgggcgcgccgggacctgaccggccggccacggttcgtgaccgcccgcaggaggagcggcgctgatgtctgacttcttcgactgcgccgaccccgatcagcgttcccgcggcatcgcggcggcggccgcggccgtcaagggcggccggctggtcgtcatgccgaccgacaccgtgtacggcatcggcgccgacgcgttcaacagcgccgcggtgtcggcgctgctgtcggcgaaggggaggggccgcgacatgccggtgggtgtcctggtcggctcctggcacaccatcgagggactcgtctacaccatgccggacggcgcccgcgacctgatccgcgctttctggccgggcgcgctgagcctggtggtgccccaggccccgtcgctgcagtgggatcttggcgacgcccgcggcacggtgatgctgcgcatgccgctgcacccggtcgccatcgagctgctgcgcgaggtcgggccgatggccgtgtccagcgccaacatctccggccatccggcggccgtcgacgccgacgaggcccgcggccagctgggtgatttggtcgacgtctacctggcggccgggcgggccgagcggggcgccgcctcgaccatcgtggacctgaccggcgccacgccgcggatcctgcgcccgggcccggtgagcgcgcagcggatcgcggcagtgctcggcatcgacccggaaagcctggccgtcccgggctgaccgaagcggttgtcgaggtcccagctttgtccagtacggtctcgttggtgtccagcgacgtaaccgaccttgccggtggtttgctcgccctttccgaccgcggcgccggtgttccgctgcgcgagctggcactggtggggctgaccgcggccatcatcacctacttcgcgaccgggccggtgcgggtgctggccacccggctgggcgcggtcgcctatccgcgcgagcgcgacgtgcacgtgacgcccaccccgcggatgggcggcctggccatgtttctcggtgtcgtctgcgccgtcttcctggcctcgcagctgccggcgctcacccgcgggttcgtctactccagcggcatgcccgccgtcctggtggccggcgctgtcatcatgggcatcggcctgatcgacgaccgctggggcctggacgcgctgaccaaattcgccggtcagatcaccgcggccagcgtgctggtcaccatgggcgtggcgtggagcgtgctgtacatcccgatcggcggcgtcggcaccatcgtgctggaccaggcctcgtcgatcctgctgaccctggcgctgaccgtgtcggtggtcaacgcgatgaacttcgtcgacgggctcgacggtctggccgccgggctgggtctcatcaccgccctggcgatctgcatgttctccgtcgggctgctgcgcgaccacggcggcgacgtgctgttctatccgcccgccgtgatctcggtggtgctggccggggcgtgcctgggcttcctgccgcacaacttccatcgcgccaagatcttcatgggcgactccggctccatgctgatcgggttgatgctggccgcggcgtcgacgacggcggccggcccggtctcgcagaacgcctacggcgcgcgcgacgtcttcgcgctgctctcgccgttcctgctggtcgcggcggtcatcttcgtgccgatgctggatttgctgctggccatcgtgcggcgcacccgggcgggccgcagcgcgttcagccccgacaagatgcacctgcatcaccggttgctgcagatcggccattcgcaccgccgggtggtgttgctgatctacctgtgggtcggcatcgtggcgttcggcgcggcgagcaccattttcttccgcccccgcgacaccgcggcggtgatgctgggcgccatcgtggtcgccgggatcgcgacggccataccgctgttacgccgcggcgacgactacgaagacgaagagtacgacaggcagtagtagtgggcttcggcctgtggtacggtgcaggtagaaccccaaaaagccgcgcaggcgaccggtccgtcggaggctgctccgatcgggccggtgcaagaccggccccgggagataccccttgggtgattcaactgtgacgtgcgatacgctcggcgggccaccgatcagtcggtcggggggttcccgttccaccaacctgggattgaggtgctgcagtgacgacaccagcgcaggacgcgccgttggtgttcccctctgttgctttccgtccggttcggctgttcgcgatcagcgttgccatcaccgcggtggcggtgctcgccgccggactgtccggtcacctgatggtcggggtcttcttcggcatcgggttgctgctgggtttgctcaacgccgtactggtgcgccgctcggttgactcgatcaccgccaaggagcacccgctgaagaggtcgatggcggtcaactcggcgtcccggctggccatcatcaccgtcgtcgggctgatcatcgcctacctgttccggcccgccggcctgggcgtgctgttcgggctggcgctgttccaggtcctcttggtggcatcgacggcgctgccggtgtggaagaaactgcgtgccggtgactgggcgccgtccgccgacggcgccgccgcggggtcggacggaacggaaggaaggaacagcaccgatgcctgagacgacgttcctggccgaatccgccatcgaggtcggcgaacacaaccacgccacctggttgggcatgaccgtcaacaccgacacgattctgtcgaccgggatcgccgcgctgatcgtcctcgcgctggccttcttcctgcgcgcgaagatcacctccaccggcgtgcccagcggcgtccagttgttctgggaggccatcacggtccagatgcgcgatcagatcgagagcgcggtcggcatgcggatcgcgccgttcgtgttgccgctggccgtcaccatcttcgtgttcatcctgatctccaactggctgtcggtgcttccgctgcagtacacggacaagtccgggcacaccaccgagctgctgaagtcggtggccgcggacatcaattacgttctggcgctggctcttttcgtcttcgtctgctaccacgtggccggcatctggcgtcgcggcgtcgtcgggcacccgctggccgtgctcaagggtcacgtggcgttcctggcgccgatcaacgtcgtcgaggagttggccaagccaatctcgttgtcgctgcgacttttcggcaacatcttcgccggcggcatcctggtcgcgctgatcgcgctgttcccgccctacatcatgtgggcccccaacgcgatctggaaagccttcgacctgttcgtcggcgcgatccaggccttcatcttctcgatcctgaccatcctgtacttcagccaggccatggagatcgaggaacaccatgactgagaccaccacgaattgccttgacccacgcacgatttcgacaagcctggtagacccctaccagttacaaggaggataagaatggctctggacccccaagtcgctgccgctgcgctcatcggcggtggactcatcatgggcggcggcgcgatcggtgccggtatcggtgacggtatcgccggtaacgcgctggtttccggtatcgcccggcaacccgaggcgcaaggccggttgtttacgccgttcttcatcaccgtcggtctggtcgaggcggcgtacttcatcaacctggcgttcatggcgctgttcgtcttcgccacacccgtcggcacctagttcgctgtgatgggtgacgcgagcctgagcgtgctggcatccagccaggtggtggccgagggaggcaacaacttcctcgtacccaacggcaccttcttcttcgtgctggccatcttcctgatcgtgctggccgtcatcggcaccttcgtggtgccgccggtgatgaaggtgttgcgcgagcgcgacgccatggtcgccaagacggccgccgacaaccggaaggcggccgagcagttcgaggccgcccaggccgattacgaagaagccatgaccgaagcccgggtgcaggcctcgtcgttacgcgacaacgcccgcgccgagggccgtaaggtcgtggaggacgcgcgggccaaggccgagcaagaggtgctgtcgacgctgcagctggccgcccggcagctgaagcgggaaagagacgccgtggaactggatctgcgtgccaatgtcgcgtccatgtcggcgaccctggccagccgaatcctcggtgtcgacgtcgcccccgccgccgcgaccacatccgcaaccaagacatccggacggtaatcgaagtatgtcgactttcatcggccagttggtgggctttgcggccatcgtgttcctggtggtccgctatgtggtgccgccggtgcgacggttgatggccgcgcgccaggaggcggtgcgccagcagctgcaggacgcggccgccgcggccgaccggttgaccgagtcgaccaccgcgcacagcaaggccgtggaagcggccaaggcggagtcgaagcgggttgtcgacgaggcgcaggcggacgccaaacgcatcaccgagcagttggcggcgcaggccggcctcgaggccgaacgcatcaaatcgcagggcagccggcaggtcgacctgctgcgcacccagctgacccgtcagctgcggctggaactcgggcacgaagcggtgcggcaggccggcgagctggtgcgcaactatgtcgccgacccggcccagcaatcggcgaccgtggaccgattcctggacgacctcgacgcgatggcgcccgcggcggccgacgtccagtacccgctgatgaccaagatgcgctcctcgagccgcgtcgcgctggtcaacctgacggagcgattcaccaccgtcgccaaagatcttgacaacaaagcactttccgccctgtccagcgaactggtgtcggtggcccagatgctggaccgcgagatcgtggtgacgcggtatctcaccgttcccgccgaggatgcgggcccccgggtccggctgatcgagcggttgctgtccggcaaggtcggcgacgtcaccctcgaggtgctgcgggcggccgtgtcggagcgctggtcggccaactccgacctgatcgacgccctcgagcacctgtcgcggcaggcgctgctcgaagtcgccgagcgcgagaacaaggtcgacgaggtcgaagaacagctgttccggttctcccgcatcctggacgtgcaaccgcggttggcaatcctgttgggcgactacgccgttccggtcgaaggccgagtgggattgctgcgcaaggtgctcgacagcgccagcatcacagtcaacccgatcgtggccgcgctgctgacccagacggtcgagctgctgcgcggccggccggccgaagaggccgtgcagttcctcgcggaggtggcggtggcgcgccgcggcgaggtcgtcgcccaggtcagcgcggcagccgacctgagcgacgcgcagcgcagccgcctcaccgaagtgctcagccgcatctacggccacccggtctcggtgcagctgcagatcgacaccgaactgctgggtggtctgctgatcgccgtggctgacgaagtgatcgacgggacgctcgcgtcccgtctggccgccgcagaggcccagttgcccgactgaccgcagcaccaaccactgaccatcccgacacacgcgataccaagatcaagtaggaagacgaaaagccatggccgagttgacaatctccgctgatgacattcagagcgccatcgaggagtacgtaggctctttcacctccgacacctcccgcgaagaggtcggtaccgtcgtcgacgccggtgacggcatcgcccacgtcgaaggcctgccgtccgtgatgacccaggagctgctcgagttccccggcggcgtgctcggcgtcgcgctcaacctggacgagcacagcgtcggcgcggtgatcctgggtgacttcgagaagatcgaggaaggccagcaggtcaagcgtaccggcgaggtgctctcggttccggtgggcgacgccttcctgggccgtgtggtcaatccgctgggccagccgatcgacggccagggcgacatcgagaccgacattcggcgggcactggagatccaggcgccctcggtggtgcagcggcagagcgtgaaagagccgctgcagaccggcatcaaggccatcgacgcgatgaccccgatcggccgtggccagcgccagctgatcatcggcgaccgcaagacgggcaagaccgcggtctgcgtggacaccatcctcaaccagcggcagaactgggagagcggtgacgagaagaagcaggtgcgctgcgtctacgtggccatcggccagaagggcaccacgatcgcgtcggtccggcgcgccctggaagagggcggggcgatggactacaccaccatcgtcgcggcgccggcctccgactccgccgggttcaaatggcttgcgccctataccggttcggcgatcgcccagcactggatgtacgacggcaagcacgtgctgatcgtcttcgacgacctgagcaagcaggccgaggcctaccgcgcgatctcgctgctgctgcgccgcccgccgggccgcgaggcctacccgggtgacgtgttctatttgcactcacggcttttggagcgctgcgccaagctttccgacgaactcggtggcggctcgatgaccggtctgccgatcatcgagaccaaggccaacgacatctcggcctacatccccaccaacgtcatctcgatcaccgacgggcagtgcttcctggagtccgacctgttcaaccagggtgtgcggccggccatcaacgtcggcgtctcggtgtcccgggtgggtggcgccgcgcagatcaaggcgatgaaggaggtggcgggcagcctgcggctggacctgtcgcaattccgtgagctggaagccttcgccgcgttcgcctccgacctggacgcgacgtcgaaggcccagctggaccgcggcgcgcggctggtggagctgctcaagcaaccgcagtaccagccgatgcccgttgaggagcaagtggtttcgatcttcctcggcaccggcggtcacctcgactcggtgccggtggaggacgtccggcggttcgaaaccgaactgctggaccacatgcgggcctccgaggacaagatcctcgccgggatccgcgacacccagaagctctccgacgaggccgccgaggagctggagaaggtgatcaacaacttcaagaagggcttcgccgccaccggcggcgcctcggtggtgcccgacgagcacgtcgaggcgctcgacgaggaggagctggaaaaggaatcggtgaaggtgaagaagccggcgccggaaaagaaggcaaagaaagagcagaagtagcaaccgatggctgccacacttcgtgaactacgcggacggatccgctcggccgggtcgatcaagaagatcaccaaggcccaggagctgatcgcgacgtcgcgtatcggtcgggcgcaggcccggctcgattcggcccggccgtacgccttccagatcaccgcgatgctgaccaccctggccgccgaggccgcgttggatcatccgctgctcgtcgagcggccggaacccaaacgcgcgggtgtgctggtggtgtcctcggaccgcggtctgtgtggcgcctacaacgcgagcatcttccgccgcgccgaggagctgttctcgctgctgcgtgagcagggcaagacgccggtgctgtactcggtgggccgtaaagcattgaactactacacattccgcaactgggacatcagcggatcgtggaccggattctccgagcagccgcagtacgagaacgccgccgagatcgccgagacgctggtcgagtcgttcatgcgcggcaccggcggcgaggacgagggtgagtccgacgccgagagcgtcgacgagctgcacatcgtctacaccgagttcaagtcgatgctgtcgcagtcggcggtggcccaccggatcgccccgatggtggtggagtacgtggaggaaccacccgaagtgcggaccctgtactcgttcgagccggacgcgacaacgcttttcgagtcgctgctaccgcgctacctgaccacccgcgtttacgcggcgctgctcgaatccgcggcctcggagctggcgtcgcgccagcgcgcgatgaagtccgcgaccgacaacgccgatgacctcatcaaggccctgacgctgatggcgaaccgcgagcggcaggcccagatcacccaggagatcagcgaaatcgtcggtggcgcaaacgcgctcgccgacgcccgctaggcagcaccactaggaagcgaaagaagatatgcctgctactgaaaccgccgacaagaacacgaagtcggccaacagcgacaccagcggccgggtggtgcgggtcaccggaccggtcgtcgacgtcgagttcccgcggggttcggtgccggacctgttcaacgcactgcacgcggagatcacgttcgaggagctggccaagacgctgacgctcgaggtcgcccagcacctcggggacaacctggtgcgcaccatgctcgctgcagcccaccgacggcctggtgcgcggcgtcgaggtgatcgacaccggtcgttccatctcggtgccggtcggccaggaggtcaagggccacgtgttcaacgccctggggcactgcctggacaagccgggttacggagaagacttcgaacactggtcgattcaccgcaagccgccgccgttcgaggagctggagccccgcacggagatgctcgagacgggtctgaaggtcgtcgacctgctcacaccgtacgtgcgtggcggcaagatcgccctgttcggcggcgccggcgtgggcaagacggtgctcatccaggagatgatcaaccgcatcgcccgcaacttcggtggtacctcggtgttcgccggggtgggggagcgcacccgtgagggcaacgacctgtgggtcgagttgcaggaagccaacgtgctcaaggacaccgcgctggtgttcggtcagatggacgagccgcccggcacccgtatgcgggtggcgctgtccgcgttgaccatggcggagtggttccgcgacgaggcgggccaggacgtgctgttgttcatcgacaacatcttccggttcacccaggccggctccgaggtctcgaccctgctcggccggatgccctcggcggtggggtatcagcccacgctggccgacgagatgggcgagctgcaggagcgcatcacctcgacccgtggccggtccatcacgtcgatgcaggcggtctacgtgcccgccgacgactacaccgacccggcgccggcgacgacgttcgcgcacctggacgccaccaccgagctgtcgcgttcggtgttctccaagggcatcttccccgcggtggacccgctggcgtccagctcgaccattctcgacccgggcgtggtcggcgaagagcactaccgggtggcgcaggaagtcatccgaatcctgcagcgctacaaggaccttcaggacatcatcgccatcctcggtatcgacgagctgtccgaggaggacaagcagttggtcaaccgggcgcggcggatcgagcggttcctgtcgcagaacatgatggcggccgagcagttcaccggccagccgggttcgacggtcccgctcaaggagaccatcgaggcattcgaccggctcaccaagggtgagttcgaccacgtgcccgagcaggccttcttcctgatcggtggcctggacgacctggccaagaaggcagagagccttggcgccaagctgtaacccgcggctggaccgaaaggtatcgaaaggtgctgtggcatggctgaattgaacgttgagatcgtcgctgtcgaccgcaagatctggtcgggtgaggcaacgtttctgttcacccgcaccacggtcggcgagatcggcatcctgccccggcacatcccgctggtggcgcaattggtcgacgacgcaatggtgcgcgtcgaaagggaaggcgaagacgatctgaggatcgcggtggacggtggcttcttgtcggtcaccgaggagacggtgacgatcctcgccgaatccgccgagttctcctcggagatcgacgagagcgccgccagagaggccgccgagtcggacgatcctcgtgtcgccgcccgggggcgcgcgagattgcgcgccgtcggcgcgatcgactagccgcctcggatgcaacgatgagcgcgcccatggccggcatggtcgtgctcgtcgtcgtgctggcggccgccgtcatcgcgctgagttatcggctgtggaagctgcgtcagggcggcacggcggggatcatgcgagacattcccgcggtcggcggtcacggctggcggcacggggtgatccgttaccgcggcggtgaggccgcgttctatcggctgtccagcctgcggctgtggccggaccgtcggctgagccggcgcggtgtggagatcgtgtcccgccgcgcgccgcgcggcgacgagttcgacatcatgaccgacgagatcgtcgtcatcgagctgcgcgacaccacccaggaccgcaggtccggctacgagatcgcgttcgacaagggcgcgttgacggcgtttttgtcctggctggagtcgcgtccgtcgccccggtcacgtcgccgcagcctctagccgggagcgggctcgccgccttgttgaccgcccggtttccacagcacgtcaccgtccgggttggccacccgggacaggatgaacaacaggtccgagagccggttgaggtacttcgcgggcagcgcgctgaccccctcgggagcggcgtccaccgcggcccacgccgagcgttcggcgcggcgcaccaccgtgcgggcgacgtgcaacagcgccgagagcggcgaaccaccgggcagcacaaaggaattcaacttcggcagcgactcgttgtatgtgtcacaccatttttcgagccgatcgatgtagggctgggtgacccgcagcggggggtactcggggtcctccaccaccggtgtcgacaggtccgcgcccgcgtcgaacaggtcgttctggatctgtcgcaacacgccggccagctccgggccgggccggccgaccgccaccgccacgccgatcgccgcgttcgcctcgtcacagtcggcgtaggccaccaggcgcggatcgttcttcgagacccgggagaagtcgctcaatccggtggtgccgtcgtcgccggtccgcgtgtagatgcgcgtcagatgcactgccatgaccaaaacggtactgcggcgcccgggcgggaccgagccttggctgactgacaaagccgacaccgcttcactagactgacccgggtggccgagcgattcgtggtgaccggcggcaaccggttgtccggcgaagtcgcagtggggggcgccaagaacagcgtgctcaagctgatggccgcgaccctgctggccgagggcaccagcaccatcaccaactgccccgacatcctggacgtgccgctgatggccgaggtgctgcgcggcctgggcgccaccgtcgaactcgacggcgacgtcgcccgcatcacctctcccgacgagccgaaatacgacgccgacttcgccgcggtgcgacagttccgggcctcggtgtgcgtgctggggccgctggtcggccggtgcaagcgcgcccgggtcgcgctgcccggtggcgatgccatcgggtcgcgcccgctggacatgcatcaggccggcctgcgccagctgggcgccacctgcaacatcgagcacggatgcgtggtggcgcaggcggatacgttgcgcggcgcggagattcagctggagttcccgtcggtgggggcgaccgagaacatcctgatggcggcggtggtggccgagggggtcaccaccattcacaacgcggcccgcgaacccgacgtggtggatctgtgcacgatgctcaaccagatgggcgcgcaggtcgagggcgcgggttcgccgaccatgaccatcaccggcgtgccgcggctgtacccgaccgaacatcgggtgatcggcgaccgcatcgtggccgcgacctggggcatcgccgcggcgatgacccgcggggacatctcggtgaccggcgtcgaccccgcccacctgcaggtggtgctgcacaagttgcacgatgccggggccaccgtgacccagaccgacgacagcttccgggtgacccagtacgagcggcccaaggcggttaacgtggccaccctgccgtttcccggatttcccaccgacctgcagccgatggcgatcgccctggcgtcgatcgccgatggcacctcgatgatcaccgagaacgtgttcgaggcgcgcttccggttcgtcgaggaaatgatccggctgggcgccgacgcccgcaccgacgggcaccacgcggtggtgcgcgggctgccgcaattgtccagtgcgcccgtgtggtgttcggacattcgggccggcgccggcctggtgttggcggggctggtggccgacggggacaccgaggtgcacgacgtcttccacatcgaccgcggctacccgttgttcgtggaaaacctggcgattttgggagcggagatcgagcgggtagagtagccaaagtcagtgccccacaagcgaggtcaccaacgcgaaggtgaacgagatcggggccttgactccctcgccggattggtactagcctggcacggctgctcccgaaagggtctgcgaagacccgaaactgggagttgactcctctgccagatctgtattaagctggcagggttgccccaaaacgggcgaaacaagtgttgtttgagaactcaatagtgtgtttggtctttttatttgttgtttttggccatacctagcactccccgtgtgtgggtatggcaatttatgatgccagtttttggcgtcttgtcaggtatctctgatttgaaattcacctcgctgcgcgaggagattttgtttggagagtttgatcctggctcaggacgaacgctggcggcgtgcttaacacatgcaagtcgaacggaaaggcctcttcggaggtactcgagtggcgaacgggtgagtaacacgtgggcaatctgccctgcacttcgggataagcctgggaaactgggtctaataccggataggacctcaagacgcatgtcttctggtggaaagcttttgcggtgtgggatgggcccgcggcctatcagcttgttggtggggtgacggcctaccaaggcgacgacgggtagccggcctgagagggtgtccggccacactgggactgagatacggcccagactcctacgggaggcagcagtggggaatattgcacaatgggcgcaagcctgatgcagcgacgccgcgtgggggatgacggccttcgggttgtaaacctctttcaccatcgacgaaggtccgggttttctcggattgacggtaggtggagaagaagcaccggccaactacgtgccagcagccgcggtaatacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgccgtaaacggtgggtactaggtgtgggtttccttccttgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatgcacaggacgcgtctagagataggcgttcccttgtggcctgtgtgcaggtggtgcatggctgtcgtcagctcgtgtcgtgagatgttgggttaagtcccgcaacgagcgcaacccttgtctcatgttgccagcgggtaatgccggggactcgtgagagactgccggggtcaactcggaggaaggtggggatgacgtcaagtcatcatgccccttatgtccagggcttcacacatgctacaatggccggtacaaagggctgcgatgccgtaaggttaagcgaatccttttaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccagtggcctaacccttttgggagggagctgtcgaaggtgggatcggcgattgggacgaagtcgtaacaaggtagccgtaccggaaggtgcggctggatcacctcctttctaaggagcaccacgaaaagcaccccaactggtggggtgcgagccgtgaggggttcccgtctgtagtggacgggggccgggtgcgcaacagcaaatgattgccagacacactattgggccctgagacaacactcggtccgtccgtgtggagtccctccatcttggtggtggggtgtggtgtttgagtattggatagtggttgcgagcatctagatgagcgcatggtcttcgtggccggcgttcatcgaaatgtgtaatttcttttttaactcttgtgtgtaagtaagtgtttaagggcgcatggtggatgccttggcatcgagagccgatgaaggacgtgggaggctgcgatatgcctcggggagctgtcaaccgagcattgatccgaggatttccgaatggggaaacccagcacgagtgatgtcgtgttacccgtatctgaatatatagggtgcgggaggtaacgcggggaagtgaaacatctcagtacccgtaggagaagaaaacaattgtgattccgtcagtagtggcgagcgaacgcggaacaggctaaaccgcatgcatggacaaccgggtaggggttgtgtgtgcggggttgtgggattgatatgtctcagctctacctggctgaggggtagtcagaaagtgtcgtggttagcggaagtggcctgggacggcccgccgtagacggtgagagcccggtacgcgaaaacccggcacctgccttatatcaacacccgagtagcagcgggcccgtggaatctgctgtgaatctgccgggaccacccggtaagcctaaatacttctcgatgaccgatagcggattagtaccgtgagggaatggtgaaaagtaccccgggaggggagtgaaatagtacctgaaaccgtgtgcctacaatccgtcagagcctcctcgtggggtgatggcgtgccttttgaagaatgagcctgcgagtcagggacacgtcgcgaggttaacccgtgcggggtagccgcagcgaaagcgagtctgaatagggcgcatcccttttggggtgtagtggcgtgttctggacccgaagcggagtgatctacccatggccagggtgaagcgcgggtaagaccgcgtggaggcccgaacccacttaggttgaagactgaggggatgagctgtgggtaggggtgaaaggccaatcaaactccgtgatagctggttctccccgaaatgcatttaggtgcagcgttgcgtggttcaccacggaggtagagctactggatggccgatgggccctactaggttactgacgtcagccaaactccgaatgccgtggtgtaaagcgtggcagtgagacggcgggggataagctccgtacgtcgaaagggaaacagcccagatcgccggctaaggcccctaagcgtgtgctaagtggaaaaggatgtgtagtcgcagagacaaccaggaggttggcttagaagcagccacccttgaaagagtgcgtaatagctcactggtcaagtgattatgcgccgataatgtagcggggctcaagcacaccgccgaagccgcggcacattcatctttacggtggatgtgggtaggggagcgtcccccattcagcgaagcctccgggtgatcggtggtggagggtgggggagtgagaatgcaggcatgagtagcgataaggcaagtgagaaccttgcccgccgtaagaccaagggttcctgggccaggccagtccgcccagggtgagtcgggacctaaggcgaggccgacaggcgtagtcgatggacaacgggttgatattcccgtacccgtgtatgggcgtccctgatgaatcagcggtactaaccacccaaaaccggatcgaccattccccttcgggggcgtggcgattcggggctgcgtgggaccttcgctggtagtagtcaagcaatggggtgacgcaggaaggcagccgtaccagtcagtggtaatactggggcaagcccgtagggagagcgataggcaaatccgtcgctcactaatcctgagaggtgatgcatagccggttgaggcgaattcggtgatcctctgctgccaagaaaagcctctagcgagcacatacacggcccgtaccccaaaccaacacaggtggtcaggtagagaataccaaggcgtacgagataactatggttaaggaactcggcaaaatgcccccgtaacttcgggagaaggggggccggaataccgtgaacacccttgcggtgggagcgggattcggccgcagaaaccagtgggtagcgactgtttactaaaaacacaggtccgtgcgaagtcgcaagacgatgtatacggactgacgcctgcccggtgctggaaggttaagaggacccgttaacccgtaagggtgaagcggagaatttaagccccagtaaacggcggtggtaactataaccatcctaaggtagcgaaattccttgtcgggtaagttccgacctgcacgaatggcgtaacgacttcccaactgtctcaaccatagactcggcgaaattgcactacgagtaaagatgctcgttacgcgcggcaggacgaaaagaccccgggaccttcactacaacttggtattggtgttcggtacggtttgtgtaggataggtgggagactttgaagcacagacgccagtttgtgtggagtcgttgttgaaataccactctgatcgtattggacacctaacgtcgaacccttatcgggttcacggacagtgcctggcgggtagtttaactggggcggttgcctcctaaaatgtaacggaggcgcccaaaggttccctcaacctggacggcaatcaggtggcgagtgtaagtgcacaagggagcttgactgcgagacttacaagtcaagcagggacgaaagtcgggactagtgatccggcacccccgagtggaaggggtgtcgctcaacggataaaaggtaccccggggataacaggctgatcttccccaagagtccatatcgacgggatggtttggcacctcgatgtcggctcgtcgcatcctggggctggagcaggtcccaagggttgggctgttcgcccattaaagcggcacgcgagctgggtttagaacgtcgtgagacagttcggtctctatccgccgcgcgcgtcagaaacttgaggaaacctgtccctagtacgagaggaccgggacggacgaacctctggtataccagttgtcccaccaggggcacggctggatagccacgttcggacaggataaccgctgaaagcatctaagcgggaaaccttctccaagatcaggtttctcacccttttagagggataaggccccccgcagatcacgggattgataggccagacctggaagctcagtaatgagtgcagggaactggcactaaccggccgaaaacttaccaacacacaactcgcaactacgatccattttcgcggcaattcgccgtggaaactcgggcaccacaccccccaccgaaacaaatttaaatagagttacggcggccacagcgacagggaaacgcccggtcccattccgaacccggaagctaagcctgtcagcgccgatgatactgcccatacgggtggaaaagtaggacaccgccgaacatacaaaaacgcccccgggaaaccgggggcgtttttacattcgctgtcgtcgaggctggtagatcgacgggcggataaccgtgcgtgcgggggcttccgctaggcgatgacttttacggcgccggcgggtctacccttgcgtcgagacgaaaaaggggaggcactcatgtcgcggacacgatcgaggcgggttcgtcatggatagatccgagatcgcggccgaattgggcgcgcccggggcgcaagagttgctcgcctccacatccgcggcgcatctggcgtatacggccaaggacgggacgccgagggtgatcccggtgggttacttctggaccggtgcggaattcgtcatcgccaccgccgccacgtctccgaaggtcgccgccctgtccgcgtgtgccgatgtcgccctgtccatcgacggtggagatacgccggagacggcgcgcgcgttatcgattcgcggacgggcccgtgtgcagatcgtcgacggcgtggtaccggagtacctggctgccgcccgcaagagcatggacgccgacgccgccgcgaggttcgaggagcaggtgcgcaagacgtacgaccgacaggcgaggatcgggatcacgccgacctgggtacgcttctacgatttcggtgcgggtcgcctgccgcgattcctcgcggacttgaccgagggcaaccgcggtgaatgaaaccgaaaatccttatgctggccagttttaccggcccggcacccgctcagtcgaatagcgtcaggctcgccggcgagtggcgcctctccagtgccagcagcgtttgtttgcggtccagtccgccgccgtatccggtcagcttcccgctggcgccgatgacgcgatggcagggcaccacgatcgcgatcgggttgtgcccgttggccaatccgacggcgcgcgcggcgccgggcgcgccgatctgctcggcgatttcgccgtacgacctggtttccccgtaggggatggtctgcagcgcccgccacacccggcgctggaattccgagccgcgcagatccagctcgatgtcgaactcggtgagctcgccggcgaaataggcaccgagttgctcgacggccccggcgaacgcccgcggattctccgtccacccggtgcggctcggttcgtaggtctggtcgaccatccgtaagttcgtcagaaccggatcgcgcccggccagggtcagcagtccgatcgggctatcgacggtgcggtactcgatcatgctgtccttacctttcttgaagggtgttcggggccgtcggccttaggcttcgaattgcccagggacgtcgggtatggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttccggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatccccttcgatggctgctgcggtggccaatggttcaccggatgctcgagagtggtccaaaggtattgcgtggcataggaacgccagggccgccagcgtgcgctggcagcggtcagcgaccgctggcccgacggcaatccgagccgtttggccgcgacgcgcagacccaggtcggcggccgggaacgcatcgggatcgcccaggccgcgcatcgcaatgacttccgcggtccacgggccgactcccggtaatgccagcaattgcgttcgggcgctttgccagtcgcacccggtatccaggacgatgctgcggtcggcgaggccggcgaccagcgcggccagcgtgcgctgccgggccttgggcaccgccagatggatggggtcgacgtcggccagctgctgcaccgacgggaaggtgtgggtcaaggttccctcggggtcgtggaccgcccggccgtaggcggcgaccaaacgccccgcatgggtgcgcgccgcccggatggacacctgctggcccagcacggcgcgtaccgcgagctcggcctcgtcgacggtgcgcggaatgcattggccgggcgcctttctcaccgccggggcgagctgcgggtcggcggccagcgcctcgtccaccgcttcggggtcggcgtcgagatccagcagccgccggcaacgggcgatcgccgccgtcaggtcccggaagtcgtcgagcaccagctcgcaacggacgtggtcggcggcgggggtcaacgtgacgatgccggtgccgaaccccagccgcagcgtgcgtcggtaggcgccgtcgcggacctcctcgcacccgggaacgacgctcgcggcgaggtgaccgaagacgccatggaagccgaagggtgtgcggaccggcagccgaaggcacacggcgccaggcgaattggccgcggatgcgcagcgcgccgaggcgcgccggcgcagcacgctcggcgggctttcgaacaccgcgcgcacggtgtcgttgaactgacgaatgctggagaagccggcggcgaatgccacgtcgccgaagggcagctccgtggtctcgatcagcacccgcgccgtctgggcgcgttgcgcccgggccagcgcgagcggaccggcgccgacctccgcctgcagcaaccgctccagctgccgggtggtgtagcccagccgggcggccaggccgccgacaccgtcgcggtccaccgtgccgtcggcgatcagccgcatcgtgcgcgccaccacgtcgccgcgcacgttccattccggcgatcccggcgaggcgtcgggacggcaccgcttgcaggcccggaagccggcgcgctgagcggccgccgcggtcggataaaaccgcacattacgggcgaacggcgggcgcaccgggcaactgggccggcagtagattccggtggtcagcacggcggtgacgaaccagccgtcgaaccgcgcatccttggactggacggcgcggtagcagcgttcgaaatcgtcgtgcacgcctcaagacttacacccgcccgccgacaaaactagcggaaaagcgacatcgtcgtcgccgggcgtggagcgggatcggcggccggctaccagccgccgcgcccgacggccgcggcggccgcgatgaagtcgcgcgccgaacgcggcaacggccggccggaatcccagatcatgccgacatcgcggtaggcatccgcgtcggccagcggcttgacggatactcccgacggatagctgctgccgtcgatcgggaccaggctgatgcccagccccgcggcgactaggctggccgcggtcgtgagattcggcgcttgcagggcgacccgaggccggaattgggctgcggcgcaaagctcgtcgaggagccgtcgcatcccgaaaccggggtgcatcgtcacgaagggctcgtcggccaggtccaccatggacaccgcggcaccgcgggcgaatcgatgaccatcgggcaccgcgacaccgaggcgctggcgaaacaggctgcgccaggccagggttcgctcgaccggtcgcggggataccaccccgatgtccacgccgccggaccgcacgcgatcggcgatcgattcggcggcgcctttctccagcgtgaaggtcacccgcggagacgactccttgaaccgggcgatcaaccgcggcaccacggttgatccgaatgaactcaggtaggccaaccggatctcgccgacggcgggatccgccagatccgctatcgcacgccgtgccgaatccagctccaactgcgcccggcgcgcgtgttcgtagaagatgcggccgtaggtgttgagggacagtcgccggccgtgacgatcgaacagcgccacgccgagtcgctgttccaggcgcgccagcatccgggtcaacgtcggctgtgcgacgtgcagctgctcggccgccgcggtgacgtgctgcagctcggcgagtgtgatgaaccactcgtagtcacccactgccatcccgcccacctctgcttatgcgctgaacgcatcatagggcgggcgaaaattcatttctgtcgggcggtgccggcccgaagcatggtggtcatgccccacggcccggtcgcgcatcaagcaggaacccgcggataccggcggatgaccgcggcgctctgcggcgccggcctggccagcttcgccgcgatgtattgcagccaggcgctgcttcccgccctgtcggcgcactaccggatcggcccggccaccgcggcgctgaccgtgtcgctgacgaccggcgcgttggcgctgtcgatcattcccgcgagtgtgctctccgagcgctacggccggatcagggtgatgctgatctcgggggtggcctccagtgtcatcgggctgttgttgccgttcagcccctcgctcggcgtgctgctcttcggacgtgcggcgcagggcgtcgcgctcgccgggatacccgcggtcgcgatggcgctgctggccgaggaggtcgacgcgtcgtccctgggatccgcgatggggcgctacatcgccggaaccacgataggcgggctggccgggcggatcgttccgtcggtggtcgtccaggtcggcacctggcgggtggccctgctggcgtgctccctcatcacgctggccggcacggcggtgttcgcggtgctggtgccgcggtcccggttcttcaccccgaagccggccagcgtgcgcgccgccctgcgcaacctcgccgggcatctgcgaaacccggtgttggccaagctttttgcggtgggctttgtgctgatgggtggattcgtgacggtgtacaactacctcggttaccggctggccgcccggccgttcgggctggcgccgtcggtggtgggcctactcttcctgctctatctcgtcgggacggggacgtcggtcgtggccggacggctcgccgatcgccggggacgccccctggtgctgggcgccgcgttacccatcgcggtggccggactgctgctgaccgtgccggccaccctggccgccatcgtcgccggcgtcggcgtcttcaccgggggcttcttcgccgcgcacaccgtggccagcggttgggtgggcgccgtcgctcagcgcgaccgcgccgaggcgtcggcgttgtatctgttcagctactacctgggtggttcggtggccggtgcgttcggcggcgtcctgtacggcgtgggcggctggtcggcgactgtctgtttcgtcgtcgtgctgctgatggccggcgccgcactggtcgcattgttggtgcgggacaacggattccgcatcggccggcgggtggtcaccagcgtggccagcgtgaagtgaggccctcggccgcgggttgcggctacggcccgggcggggtccccacgcagacaccgccggcgcaggcgcccgcgccgccgggccccgcggatgctccggcgcccggcacactcgcgctcgcgccgccgggtccggcgcccgccccggatccgccggggccggcggtggtcgcaccgcccggtccgacgatcgggccaccgccaccgcccggcccggcggtggtcgtcgccgccggtgcggtggtcgtgacggtgaccggtgtcgtgacggtggtggtgacggtcgaggtcgtcgggctcttgttgttgcccgagctgcaccccgcggccagcgggctcaacgctatcgcggcggccacccccgcggcgacggaaatacggcgggcacttcggctaccggtcacgtcgaaaccaatctctcgaggggttagagtcgttgtccctctacccatttcttccgaaaatcaatccgttccggccggccggtcggcggcgccggcgggcgaggccagccgggtgggacgctcgtggccgcgcagggtcacggtgtcgcccaaagaccaacgggcccgctctttttcgctcgcgccttcgatggcgtcgcccgtcgcgagcaggcggctggagtgcgacttggcgagctcgcacagccgggccgcctcgttgaccggttcaccgatgacggtgtactcgaagcgttcccgggcgccgacgttgccggcgacgacctgcccggccgccacgccgatgccggcgcgacactgcggcatctcgttggccagccggtcggcgatggcgcgcgcggccgtcagggccgcatcctccgggcagtcaagatgattcggcgccccgaagatggccagcgtcgcgtcaccctcgaacttgttgaccaagccgcagtgccggtccacctcctcgacgacgatgccgaagaactggttgagcaccgataccacctcggccggcggccggcgggtgaccagttgggtggagccgacgatgtcgatgaacacgacggcgacgtggcgttcttcgccgcccagcttcggccgttcccgctcggcggccagcgccacctcgcgaccgacgtgccggccgaacaggtcgcgcacccgctcgcgctcccgcaggccgtccaccatcgcgttgaatccccgttgcagctcaccgagttcggtgccgtcgaacaccaccaggtcgccacgcaggtcgccgcgctccacgcgtttcagggcggcacgcaccacgcgcacgggcgtcgcggtgagccaggccaggatccacatcagcaggcagccgaagatcagcgccgccgtcgacacgatcagcacgccgacggcgaactcggtctcggtcaggttccgcagccatatctcgaacagcgccaacagggcgatgccgatgacgggcacgcccgagccgaggaaccacaccgtcatggtccggcccatgatgcccgcggtcagtcgccggggcggcggtcccgcctcgagggcctgagcagccaccgggcgcagcgcgaactcggcgagcaggtagcacgcggtggccaccaggacaccacagaagctcaccccgaacaggaaccgcgggatgaacatggtgtcgaccaggccgtagaggacggtcagcaacagcgtcccggcgccccacaacaccagatccaccagcgcgattcgccacggggccaggaaggtgttgcgttcgtcggtgggggtgggcttgcgctcctcgatggcccagcgcagcgccagcacggtccgccgggtgatccagtaggtgcccaccgccaacgccgacgccacataggccggcccgaccccgaaggtgatccatgccggcgcgtcgttgaacacgctcggcgccggaatggcgacgatcaccagaatcagcgcggccccgatgccgatcaggttggcgcccagcaccatcacggtcatgatgatctggatgcggatccgccgccggtgctggctctcggtgacccgccccagcagcagggagccgtaggcgggggtctccggcaggcggccgctttgccgggtgatcttttcgagcacccggccgatgcgttgtgccgtgctctgcgtggccgacatggtggcgtcagcctaatttgtcggccacgctctaaggtgagtcgggtgcgtctagtgatcgcccagtgcaccgtggattacgtcggccggctcaccgcgcatctgccgtcggcgcgcaggctgctgctgttcaaggccgacggatcggtcagcgtgcacgccgacgaccgtgcctacaagccgttgaactggatgagcccgccgtgctggctgcgcgaggaggctggcgatgcggcgccggtgtgggtggtggagaacaaggccggcgagcagctccgcatcaccgtcgaggacatcgagcacgactccagccacgacctcggcgtcgatcccggcctggtcaaggacggcgtcgaggcgcacctgcaggccctgctcgccgagcacgtgcaactgctgggcgaggggtacacgctggtccgccgcgagtacatgaccgccatcgggccggtcgatctgctctgccgcgacgagcgcggcgggtcggtggcggtggagatcaaacggcgcggcgagatcgacggcgtggaacagctcacccgctacctcgagctgctcaaccgtgacagcgtgctggcgccggtgcgcggcgtgttcgccgcgcagcagatcaaaccgcaagcccgcacgctggccaccgatcgcggtatccgttgtgtgacattggattacgacaagatgcgcgggatggacagcgacgaataccggctgttctagggcctcgcccctacactggtcgcatggctcggcgccgcacaccgccccgccggcaacggctgctcgggccgccaccggcactgcgccgggtggaagtcgggcccgacgggcatgactacgaggtccgtcccatcgcggcggcgcgtgccgtcaagacctaccggtgccccggctgcgatcacgaaatccgttcgggcgcagcccatctggtggtatggccggtcgagccgacgctcgggggagccgaggaccgccggcactggcacaccggctgctgggcgcaccgcgccacccgcggccccacccggaggtggtcgtgaatccgacggctcaggcggccggctcgacgagctcgatgagcacgccgccggcgtccttggggtggatgaagttgatccgcgagtttgccgtgccgcgacgcggtgcgtcgtagatcagccgcacgccttgctcgcggagccgctcgatcagggtgtccaggtcgctgacccgcatcgccatctgctggatgccaggcccccgcttgtccaggaacttcgcgatggtcgaggagtcgtcgatcggggccatcagctgcagctgcgcggtgcccgccggggcaccccgcacggccagcatcgcctcgcggattccctgctcctcgttgacttcctcgtgcaccaggatcatgccgaggtggtcgtgataccaggcgattgccgcgtccaggtcggcgactgcgatgccgacgtgatcgatcgccgtcaccagcgcggtggccaggacctgacgggcgtcaacttgatcggtcgtcatctcataacggtaacctgacggcaaagattgcgcttctccgggaggctcccgggaggcattagcaggcctgaggagagagtcatgacgacgtcggtgatcgttgctggagcgcggacacccatcggcaagctgatgggttcgctgaaggatttctccgccagcgacctgggtgccatcgccatcgccggcgcgctggagaaggccgacgtcccggccgacctggtcgagtacgtgatcatggggcaggtgttgacggccggggccggtcagatgccggcccggcaggcggccgtggcggccggcatcggctgggacgtgccggcgttgagcatcaacaagatgtgtctgtccgggatcgacgccatcgccctggccgaccagctgattcgcgccggagagttcgacgtggtggtagccggcggtcaggagtcgatgaccaaggcgccgcacctgctgatggacagccgcgcgggctacaagtacggcgacgtgacggtcctggaccacatggcctacgacggcctgcacgacgtgttcaccgaccagccgatgggcgcgctcaccgagcagcgcaacgacgtcgacaagttcacccgcgaagagcaggaccagtacgccgcacggtcgcatcagcgggcggccgcggcgtggaaggacggcgtgttcaccgacgaggtggtgccggtgaacatcccgcagcgcaagggcgatccgctgcagttcaccgaggacgagggcatccgcgccaacaccaccgccgagtcgctggccggcctcaagccggcgttccgcaaggacggcaccattaccgccgggtcggcctcgcagatctccgacggcgcggccgcggtggtcgtgatgagcaaggccaaggcccagcagctcgggctgagctggctggccgagatcggtgcgcacggggtggtcgccggaccggactccaccctgcagtcgcagccggccaacgccatcaagaaggcgctcggtcgcgagggcatctccgtcgaccagctcgacgtggtggagatcaacgaggcgtttgcggccgtggcgctggcctcgacccgcgaactcggcgtgaatcccgacatcgtcaacgtcaacggcggtgcgatcgcggtcgggcacccgatcgggatgtcgggggcgcggatcaccctgcatgccgcgctggaactgtcgcggcgcggctcgggctacgcggtcgcggccctgtgcggggccggcgggcagggcgacgcgctgattctgcgggcgggttagccagcggtcgcggcgttcgccgaggttgctggcattcgcccgccgtgacgaagtgtgatcttcgtcatatcggccgatcacaccgctttttcggggctttttcgggtgccttcgccgcggccgggccggtgcctgagcgccgtcgccaccgggtggagcggttgccgatgcgcatgccaaacttgacgacgtgacacgtccgcgaccttctatcggccccgccctggccggggccgtcgatctttccggtctcaagcagcgggcccaggcggcgagcggcccggccggcgggcccgcgccggccgacggtggccccggcatcagcgcggtcaccgaggccaacttcgaggccgaggtgctgatccggtccgaggaagtgccggtggtggtgctgctgtggtcaccgcgcagcgacgcgtgcgtccagctgctcgacacgctgtccgggttggccgcccaggacaacggcaagtggtcgttggccaccgtcaacgtggacgtggcgccccgggtggcccagatattcggggtggatgccgttccgaccgtggtggcattggctgccgggcagccgatttcgagcttccagggcatgcagccggcagaccagttgcgcggctggctcgatcagatcctttcggcgaccgccgggaagctcaagggcgcaacgggttccgcggaatccgaggcggtcgacccggagctggccgcggcccgtcaacagctggaggccggcgacttcgaggcggcccggacgtcgtatcaggcgatcctggatgccaacccggccagcacggaggccaagggcgccatccgccagatcgactttctcacccgcgccaccgcgcagcgcccggacgccgtcgccgtcgccgatgccgcgccgggcgacatcgacgccgccttcgcggccgccgacgtgcagatcctcaaccaggacgtcggcgccgcgttcgaccgcctgattgccttggtgcgcaacacatccggcgacgaccgggcccgggtgcggacccggctggtcgagctgttcgaccttttcgatccggccgaccccgaggtcgtggccggacggcgcaacctggccaacgcgctgtattaagcgcgctcgcgaaagtggttgcgggctacttgggttccagccacagcgccgacgtcggcggcagcaccagcaccgccgaggcgggccgaccgtgccaggggtcctcggtggcgtcgacgccgcccatgttgccgatgcccgagccgttgtagaccgtcgcgtcggtgttgagcacctcgcgccagcggccggccgacggcaatcccagccggtagccgctgtgctcggcgccggcgaagttgaagacgcacgccatcaccgagccgtccttgccgtagcgcaggaagctcagcacgttgttggccgagtcgttggcgtcgatccaggagtagccgtcgggcacggtgtcctggctccacagcgccgggtggctgcgatagatgtcgttgatgtcgcgcaccagacgcaggatcccgttggagaagccctgctcgtcgagctgccaccagtccaggccgcgttcttcggaccactcggcgcgctgcccgaattcctggcccatgaacaacaattgcttaccggggtgcgcccactggtaggccagcaggctgcgcagcccggcggctttgacgtgattgttgcccggcatccggccccacagggtgcccttgccgtgcaccacctcgtcgtggctgagcggcagcacgtagttctcgctgaatgcgtagagcatcgagaacgtcatctcgtggtggtggtagctgcgatagatcgggtcacggctgatgtagtccagcgtgtcgtgcatccagcccatgttccacttcatcgaaaatccaagtccgccaaggtttgtcggcctggtcacgccgggccacgaggtcgactcctcggcgatggtgacgatgccgggcgcggacttgtgcgcggtggcgttcatctcctgcaggaactggacggcctccaggttctcccggccgccgtagatgttgggggtccagccgccctcggggcgggagtagtccaggtacagcatcgaggccaccgcgtccacccgcaacccgtcgatgtggaactcctgcagccagtacaacgcgttggccaccaggaagttacgcacctcccgacggccgaagtcgaatacgtaagtgccccagtcgagttgctccccacgcttggggtcggagtgttcgtagagcggggtgccgtcgaaccgtcccagcgcccacgcgtccttcgggaagtgtgccggcacccagtcgacgatcacaccgataccggcctggtgcagggcgtcgaccagcgcccggaactcgtcgggcgtgccgaatcgggaggtcggcgcgtagtacgacgtcacctggtatccccaggagccggcgaacggatgctcggcgaccggcagcagctccacgtgggtgaagccgtgctccaccacgtagtccgtcagctcgcgggccaattggcggtagctgagcccgggacgccaggagcccaggtggacctcgtaggtgctcatcggctcgaagaccgggttacgcgcggcgcgctgggtcatccagtcggcgtctccccaggtgtagctgctgagcgtcacccgggaggcggtgtgcgggggcacctcggtggcgaacgccatcggatcggcccgctcggtgaccacgccgtcggcgccgtgcaccttgaacttgtacagcccgccgatcgggaagtcgggccagaacagctcccacacgcccgacgagcccaacacccgcatcggggcttcggtaccggtccagccgttgaactcaccgatcaaactgatgcccttggcgttgggcgcccacaccgcgaacgacaccccggtgacgacgccgtcggccgtggtgaacgagcggggatgcgcgccaaggacttcccagagccgctcgtggcgcccctcgccgaacaggtgcaggtcgacctcgcccagggtgggcaggaagcggtaggcgtcggcgacgacgtagggctcggagtcggggtaggtgatctgtagccggtagtcgatcaggttcgtgaagggcagggccaccgcgaaaaggccggattcgatgtgctgcatcgcgaaccggtcgccgccgaccagcgcggcgacctcggtcgcgtgcggccggaacgcccggatgacggtgtgatcgccgtattcgtgggcccccagaattccgtgcgggtcgtggtgggtgccggcgaccaggcgcgacaggtccgcaggatcgggcgccaggtgcgtccgagcgagttgatcggcgtggctcatgtccctttcacctccggtccgtttcgtcgtgcgttcagcgcctgcgtagcaaggtcattcgagcctcatcggggatgagcggcatgttgatgacgtgagcgaccgcctgtgccgggtcgatgcgaacgtaattggcttgcccccactggaattcctggccggtgatctcgtcgcgcacccaaaagcgctcgtaaggctccatacccaatgccgccatgtctaaaaacagcgtcgcttcctcggggccgaatgcgttgagcgtcaccaccaccagcacgcagtcgccggtggccgggtcgaacttgctgtaggcgagcagcgcgtcgttgtccacgccgtggaaatggatggtgcgcagctgttgcagcgcggggtggagccgccgaatcgtgttgagctgcgtgatgaatggctcgagcgaccttccctcggcgagcgcgccggcgaaatcgcggggccgcagttcgtacttctcggagttcaggtactcctcgctgccctcgcgcaccgcgcggtgctcgaacagttcgtagcccgagtacaccccccaggccggacccatcgtggcggccagcaccgcgcggatggcgaacatccccggaccgttgtgctgcaggatggcgtgcaggatgtcgggtgtgttgacgaacaggttgggccggcggaaatcggccagcgcggcgatgtcgttgccgaactcggtcagctcccacttcgcggtgcgccaggtgaagtacgtataggactgggtgaagcccagtttggtcagcccgttttgccggaccggcggggtgaaggcctcggacaggaacagcacatcgggatcgatgcccttgaccgcggcgatcagccaggcccagaagtccggcggtttggtgtgcgggttgtcgacgcgaaagaacttgacgccgtggtcgatccagtgccggaccacccgcagcacctcgtcatagagaccggccgggtcgttgtcgaagttgagcggatagatgtcctggtacttcttgggcgggttctccgcgtacgcgatggtgccgtccggcaattcggtgaaccagttgcggtgctcgcgcgcccacggatgatccggcgcgcattgcagcgccaggtcgagcgccacctccatgcccagttcgcgggcccgggcgacgaacgcgtcgaaatcctcgatggtgcccagatccgggtggacggcgtcgtggccgccctcgtcgctgccgatcgcccacggcgagcccacatccgtcgggccggcggtgggagagttgttgcgccccttgcgatgtaccttcccgatgggatggatcggcggcaggtagacgacgtcgaagcccatcgccgcgatgcgcggcagcgccgcggccgccgtcgcgaaggtgccgtgcacggggttgccgtcgtcgtcccagccgccggtcgagcgggggaacatctcataccaggagccgaagcgggccagcggccgatccacccagaccccgtactgctcgccgcgggtcagcagatcgcgcagcggatactccgccaggatctcctcgatttccggcgccagcgccagcgccgtccgggtgaccgggtccccggcggtgcgcagcgcggccgcggcggccagcagcggttcgcgccgggcgcgcggcacacccgtggcggcgcgctcgaacagctccgcgccgaccagcagatcgttggacagctccgtctcgccctggccggcgtccagcttggcgaccagcccgtgccgccaggagtggatcgggtcgccccagccgtccacccggaaggtccataatccgacctggtcgggggtgaactgaccgtggaagacgtagggttcggggcccatcgtcatcggcagcgacagcggcttgatccgttgctggtcgaccctgccctcgcggtcggcgaccggtgcctgcaccgccttgacccggcgcgtctcggtcaccggcggataggccggtcccaggtagcgcaccaccagcgtcgcggccaccgcctcgtgtccctcgcgccacaccgaggcgctgaccggcaccacctcgccgacgacggccttggcgggatatgtcccacaggagacgaccggctggacgttatcgatctcgacacgaccgggcaccaacactccgttccgatctgcccgggtccttcgcgcccgcctggcggttcgcaatcggcaccggggtttccgattgtgggcggcccacccgcggtgtgctccgtgcggaatgccgctcgtcgggaaacttcctgtggtggggaactttctgggtggggaagcatcgtcgcgaccccgataactatccggtacccaccctagtctccggtcacacccccgccactgaaaagcaaacgcgggcgcacggcagcggtgttttcccgccgccgtgcgcgggccgggaacctcagtaaggtagggacgcgtgaaagccctccgccggtttaccgtccgtgctcatctgcccgagcgtctggccgcgctggaccagctgtcgaccaacctgcgctggtcgtgggacaagcccactcaggacctcttcgcaagcatcgatcccgagctgtggcagcgctgcggcagcgacccggtggcgttgctgggcgcggtcaaaccggcgcggctggacgagttggcggtcgacgagacgttcctgggccggctcgacgagctgaccgccgacctgaacgactacctgagccgcccgctgtggtaccagcagcagcaggaccagggggcgcagatgccggcggccatcgcctacttctcgatggagttcggcgtcgccgaggtgctgcccaactactccggcgggctggggatcctcgccggtgaccacctgaagtccgcgtcggatctgggtgtgccgctggtggcggtgggcttgtactaccgctccggctacttccggcagtcgttgaccgccgacggctggcagcacgagaactacccggcgctggacccccaggggttgccgttgcggctgctgagcgacgccaccggcgatcccgccctggtcgagttgacgctgcccgactccgcgcagctgcatgcccgcatctgggtggcccaggtgggccgggtgccgctgctgctgctggattccgacgtgcccgagaacgagcacgacctgcgcggcgtcaccgaccgtctgtacgggggcgatcaggagcatcggatgcggcaggagatcctggccggcatcggcggggtgcgggcgatccgcgcctacaccgcgatccacgggctgcccgaacccgaggtgttccacatgaacgagggccacgccggtttcctcggggccgagcgcatccgcgagctgatgacgggttcgggcttggacttcgacaccgccctggcggtggtgcgatccagcacggtgttcaccacgcacacaccggtgccggccggcatcgaccggttccccatcgacatggtgcggctgtacttcgacgaccacgccgacgacgcggcgggagcgcccgtgctgctgccgggggtgccgaccgcccgcatcctggcgctcggcgcagaggacgatccgacgaaattcaacatggcgcacatgggtctgcgcctggcccagcgggccaacggtgtgtcgtcgctgcacggccgggtgagccgggccatgttcaacgagctgtggccgggcttcgacagcaacgaggtgccgatcggttcgatcaccaacggggtgcacgcgcgcacctgggcggccccgcagtggctgcagctgggttacgaactggcggggtcggattcgttcagcgacccgggcgtgtggctgcgggtgcagcaggtcgacgccgggcatctgtgggggatccgctgccagctgaggtcgttgctcgtcgaggacgtgcggcagcggctgcgccgctcatggctggaacgaggcgccacggacgccgaattgggttggatcgaaacggctttcgatcccgacgtgttgaccatcgggttcgcccggcgggtgccgacgtacaagcggctgacgttgatgctgcgcgaccccgaccggctgcagcagttgctgctcgacgagcagcggccgatccagttgatcgtggccggcaaatcgcacccggccgacgacggcggcaaggcgttgatccagcaggtggtgcggttcgccgaccggcccgaggtgcgccaccgcatcgccttcttgcccgactacgacatgtcgatggcgcggctgctgtactggggctgcgacgtctggttgaacaatccgctgcggccgctggaggcctgcggcacctcggggatgaagagcgcgctgaacggcgggctgaacctgtccatccgcgacggctggtgggacgagtggtacgacggcgaaaacggttgggagatcccgtccgccgacggtgtggccgacgagcagcgccgcgacgacctggaatccggcgcgctctaccggctgctcgaggaagcggtggcgccgaagttctacgaacgcgacgagcgcggggtgccgccgcgctggatcgagatggtgcgccacaccctgcagacgctcggcccgaaggtgctggcgtcgcggatggtgcgcgactacgtcgagcagtactacacgccggccgcgcagtcgtggcgccggacgatcggaccggccgagggggcgaccggcggcgccgagttcggcgccgcccgggagctggccgcctatcgccggcgcgccgaagaggcatggcccaacatcgtgatcaccgatgtggacagcaccggcctgcccgacagcccggtgctcggctccaagctgaccctgaccgccaccgtggcgctgggcgggctggcgcccgacgaggtcaccgtcgaggcggtggtgggccgggtggacggcagcgatgcactgctcgagccggtcaccgtcgagatgtcgtacgccggtacggccgagggcggcaaccaggtcttctcgacgacgacgccgctgccgctggccgggtcggtcggctacacggtgcgggtgctgccccggcatccgatgctggccgccggcaacgagctgggcctggtcaccctggcccgctagccgtcgcggcggtgcgcagccgctgcagcgccgcccgcacctgcgcgccgttggtggtctgccagaacggcggcagcgaggcgcgcaggtagccgccgtagccggcggtggccatgcgcgagtcgagcaccgcgaccacgccgcggtcgctgacccgccgcaacagccggcccgagccctgcgccagcagcagcgcggcatggctggcggcaacggccatgaagccgttgccgccgcgcgcggccaccgcgcgctgccgcgccccgagcagcgggtcgtcgggccggggaaacgggatgcggtcgatcaacaccaacgacagcgacgggccgggcacgtcgacgccctgccacagcgacagggtgccgaacagcgacgtctgcggctcggcgctgaactgctcgaccagcgccgaggtgctgtcgtcgccctgacacagcaccggcgtcgacagccggtcgcgcatcgcctcggcggccgcccgggcggcccgcatcgacgagaacaggcccagggtgcgcccgtcggcggcggtgatgagctcggcgatctcggtcagctgctcggccgagccgacgccgtcgcgtccgggcggcggcagatgcgctgccacgtaaaggattccggccttggcgtgctgaaacggcgaccccacgtccaggccgcgccagggcgggtcgtcaccgtcgggtcctttcagcccccaggcagcggccatggcgtcgaaggagccgccgatggtcagcgtcgccgacgtcagcaccacggtggaacgcgagaacacccggtcgcgcaacaggtcggccaccgacagcggggccacccgcagcaccgggcgcatcgcgccccggttgtcctcgtggtccagccacaccacatcggtacggtcggggatggccgggccgaacgacgccagcacccgcgacgcggtgtcggagatctcgctcagtgccgcaaccgcttcggcgcgcgcggacgccgccttggggtcgctggtggtgtcgatcgccgagcgggccgcgctcgccgcgtcgcgcagcgccgccaggtaggtcgccagctcgtcgtcgaggcgatcgatgcgccccggcgtgccgtcgtggatggccgcggcgaaggtcgccgtcgtcgcctccagccgctggaccagttccgggctcaccagccggccgatccggcgcgcggcgacgccgagggccgccgacgtcagctccgcggtggccaccgcggtcacccggtccaccagctcgtgcgcctcgtcgatgaccagcagcgcgtgctcgggcaggatcgccgagtcggacaccgcgtcgatggccagcagcgcgtggttggtgaccacgacatcggcctgaccggcccggctgcgcgcgcgctcggagaagcattcggcgccgaacggacagcgcgccaccccgaggcattcccgcgccgaaacgctgacctgcgaccaggaccggtccggcacgctgggcttgaggtcgtcgcggtcaccggagtcggtgctcgacgcccattcggtgagccgttgcacgtcgcggcccaacgcgctgaccgccatcgggttgaacagttcctcctgcggccggtcggcggcttcctcaccgtcggccggcccgccgttgtgaatcttgttcaagcacaaatagtttcgtcgtcccttgagcaacgcgaactggggccgccgcggcagcgccgcggccagcgagtcgatcagccggggcaggtcgcggtcgacgagctggcgctgcaacgcgatggtggccgtcgacaccaccaccggggagtcgtcgcgcagggcgtgcacgatcgcgggcaccagatacgccagcgacttgccggtgccggtgccggcctgcacgaccaggtgccggccggtgtcgaaggcctgggccaccgcggcggccatctgctgctggccttcgcgctcgctgccgcccagcgcggccacggcggtggccagcaactcgggcacggaaagctcggacgtgacgatcctcttcgctcggttctgctcggtcgagcccggtcagtcgatgccgggcggccgtcgccggtcggccgggatctgggtggtcgggatcgccggttcgccgtgggacaggttcagcccctcccacggcagactgcgcagcccggaagctaccagttcgcgcgccgcggcgaggttcggtttggacaccagctcgccgccgcgcaccaacggcaccgtcaccgcccgggccggctcggcgacgtccggccgatggccggccgggtagaccagctcctcggtgatgatgccggtgtcccgggagagccgcagcgcctccttgcgcccgccccgggattccttgtggctgctgcgcttctgcaccggcaggccgtccacctcgacgagcttgtagaccatgttcgccgtcggggcgcccgaaccggtcaccactgaggtgcccacgccgtagctgtccaccggctcggcggccagcgcggcgatggagaactcgtcgaggtcaccggagaccacgatgcgggtgcgggaggctcccagcctgtccagctgctcgcggacctggcgggccagcacgcccagctcgccggagtcgatgcgcaccgcgcccagcccggcgccggccgccgtcaccgcgttggccaccccggtcgtcacgtcgtaggtgtccaccagcagcgtggtgtcgacgccgagcgcctgcacctgtgcccgaaacgccgccagttcagtggattccgcggcggcgtcggtgcgggcgtgcagcatggtgaacgcgtgcgccgaggtgccctcggccggaattccgtagcagcgctgggcctccaagttcgaggaggcggcgaagccggcgatgtaggcggcgcgggccgcggccaccgccgcctgctcatgcgtgcgccgtgaccccatctcgatcagcggccggcccctggccgcgctgaccatgcgcgccgcggcggacgcgatcgcggtgtcgtggttgaagatcgacagcgccagcgtttcgagcaccacgcattccgcgaaggtcccggtcaccgacagcaccggcgacccggggaaatacagctcgccctcggcgtagccgtcgatgtcgccgccgaaccgaaaatcgcgcaggtaccgcagcgtgtcgggatcgaggaattgccgcagcgactggcaggcctcgtcgccgaaggtgaactgcggcagcgcctcgagcagccggccggttccgcccacgacgccgtaccggcgtccctcgggaagccggcgcgcgaacagttcgaaggtggtccgccgaccggcgctgccgtcgcgcaacgcggccgccaacatggtcaactcgtatttgtcggtcaggagcccagtgacgaccgggtcgttcattccataacggtatcggctgcgaatcggggctcggtaacgtcgtccatccctcggtatcgtgggggccatggttgttatgtcagcgcccaccgagccgaagtccaggccgggcactacaggacaacgcgagtccgctcccgaggacgtcacggccagcccgtgggtcacgatcgtctgggacgacccggtcaacctgatgacctacgtgacctacgtgttccagaagttgttcggctacagcgaaccgcacgccaccaagctgatgctgcaggtgcacaacgagggaaaggccgtggtgtccgcgggcagccgcgaggccatggaagtggacgtgtccaaactgcatgccgccggtttgtgggcgaccatgcagcaggaccgctgagattcggggcaccggcgatttcctgtgcgcaagtggaagcgggtcgagactgcggaaggtccccgttttcggtccgccctggcctcccatgaggccgcgctgctcaaaaacctggccaccgcgatgatcgggctgctcgatgagcgtgaatcctcttcgccggcagacgaactcgaggaaatcaccggcatcaagaccgggaacgcgcaaccaccgaaggatccgacgctgcgccggctgctgcccgacttctaccggcccgacgacaacggcgacgagtcgcccgatgccgccgagagcctgaacgccgcgctgcgcagcctgcacgagcccggcatcgtcaacgccaaacgcgttgccgcacagcgcttgttgggcaccgtccccgacgacggcggccggttcgagttgaccgaggacgacgcgaacgcctggatcgcggcggtcaacgacatccggctgacgctgggcgtcatgctcgaaatcgggccggacggcccggagcggctgccggccgaccatccgctggccgtgcacttcgacgtctaccagtggctgaccgtgctgcaggagtacctggtcctggtgctcatggggccccggtcatcgtgacggctcggcgatgaacgccatcaccgacgtcggcggcatccgcgtcggccaccaccagcgattggatcccgacgcgtcgctgggcgccggctgggcctgcggcgtcaccgtcgtgctcaccgcgccgggcaccgtcggcgcggtggactgccgcggcggtgcgcccggcacccgcgagaccgacctgctggacccggccaacaccgtgcggttcgtggacgcggtgctgctcgccggcggtagtgcctacgggctggccgccgccgacggcgtgatgcgctggctggaggaacacgaccgtggggtggcgatggacggcggcgtggtgcccatcgtccccggggcggtgatcttcgacctgcccgtcggcggctggcagtgccgcccgacggccgagttcggctacctggcctgcgccgccgccgcgcgcgacgacgacgcgccggccgtcgggaccgtcggcgccggggtgggggcgcgggccggcgcgctcaagggcggcgtcgggaccgcctcgcgcaccttgcccagcggtgtgaccgtcggggcgctggccgtggtgaactccgcgggcgaggtcgtcgaccgggcgaccggattgccgtggatgacggacctggtcgagcagttcgggctgcgaccgccgccggccgagcagatcgaggcgttcgccgcgttgccgtcgccgtcgaacccgctggacaacccgctcaacaccgtcatcgcggtggtggccaccgatgccgcgctgagcgcggcggcctgccggcgggtggccgtcgcggcccacgacggcctggcccgcagcatccgcccggcccacaccccggtcgacggtgacaccgtgttcgtgctggccaccggggcggtcgaggtgccgcccgaggccgatacgccggccgccttctcgccggagacccggttggccaccgaggtgggcgtcgccgccgccgactgcctggcgcacgcggtgctgggcggtgtgctggccgccgactccgtcgccggcatcccgagctaccgggacgtgctgcccggcgcgctgggccggtgaacgccgaccggtagccttgacgatgctggcagcgcgctggaagggcagccatgggtaagaccaccggacgggcacctgccgcccagaccaagaagcggtccacggcggcggcgggcgccaccaccatcgtcaccttcgtcgcgctgctctacctcgtcgagctgatcgaccagctgacccgccacgccctggacgtccacggcatccggccgcagcgggtcgacggcctgtggggcatcgtcttcgccccggtgctgcacgagagctgacagcacctgatggccaacaccgtgccgctgctggtgctcggattcctgatgacgctggccgggctggcccggttcgtctgggcgaccgtgatcatctggatcgtggggggtttcggcacctggctgatcggcaacgtcggcagcagttgcgggcccaccgaccacatcggggcctccggcctgatcttcggctggctggccttcctgctggtgttcggcatcttcgtgcgccgggtccgcgacatcatcatcggcctggcggtcatgttcgcctacggcggcgtgctgctcggcgccatgccggtgctcggcctgtgcggcggcgtgtcctggcagggccacctgtgcggggcgatcgccggcgtgctggccgcctacctgctgtccgaaccggaacgcaagggccgctccggccgcaagaccggcgccggcgcgccgcgccccaagacatgagctcggcactggcgcccgtcgggatcttcgactccggcgtcggcggactgaccgtcgcgcgggccatcatcgaccagctgcccgacgagcacatcatttacgtcggcgacaccggccacgggccgtacggcccgctgagcattcccgaggtgcgggcgcacgcgttggccatcggcgacgacctggtcggccgcggggtcaaggcgttggtgatcgcgtgcaacaccgcgtcggcggcctgcctgcgggatgcccgcgaacgctacgaggtgcccgtcgtcgaggtgatcctgcccgcggtgcgccgcgcggtcgccaccacgcgcaacggccgcatcggggtgatcggcacccaggcgaccatcaattcgcacgcctaccaggacgcgttcgccgccgcccgcgacaccgagatcaccgcggtggcctgtccccggttcgtcgacttcgtcgagcgcggggtgaccagcggccgtcaggtgctcgggctggccgagggttatctggagccgctgcagcgcgcgcaggtcgacacgctggtgctcggttgcacgcactacccgttgctgtcggggctgatccagttggcgatgggggacaacgtgacgctggtatccagcgccgaggagaccgccaaggaggtgctgcgggtgctcgccgagcgggacctgctgcacccgcaccccgacgatccccgcgccgccgggccgtcccgggtgttcgaagccaccggcgaccccgaggcgttcacccgattggcggcccggttcctgggtccggccgtctcgggcgtccggcctgttcatcatgtgcgtatcgactgacccgcggacgagattctcgtcacaccaatgcggcaatgttttcgtcatggtcccatcgggcatggcacagtagtgtccgtgcgaataaccgtgctcggctgctcgggcagcgtggtgggtccggattcgcctgcgtcgggttatctgcttcgggcaccggatactccgcccttggtcatcgacttcggcgggggtgtgctgggcgcgctgcagcgctacgccgatcccagttcggtgcacgtgctcctgtcgcatctgcatgccgatcactgcctggatctgcccgggcttttcgtctggcggcgctatcacccgacgcgcccgctcggcaaggcgatgctgtacggccccggcgacacctggtcgcggttgggcgcggcgtcgtcaccctatggcggtgaaatcgatgattgctcagacattttcgacgttcgccattgggtcgacggcgagccggtgacgatcggagggttgacggtgacgccgcgggtggtggcccatccgaccgagtcctacggcttgcgcgtcaccgatcacaccggcgcgtccttcgtctacagcggtgacaccggcgcctgcgatcagctcgtcgagctggctcgcggcgccgatgtttttttgtgcgaggcctcctggacgcattcgcccgaccgcccgcccgcgctgcacctgtcgggcaccgaggcgggccgggccgcggcgcaggccggcgtccatgagttgttgttgacccacatcccgccgtggacctcgcgggaggacgtcatcagcgaggccaaggccgagttcgacggccccgtgcacgcggtggtgtgcggcgagacgttcgacgtccgccgttccgagagggtctgagccgaccggttcgaggtggcttagggttactgggtgacgcgacgagaagacggccgcctggacgacgagcttcgcccgctggtgatcacccgcgggttcaccgaacaccccgccggttcggtgctgatcgaattcggccacaccaaggtgatgtgcacggccagcgtcaccgagggcgtgccgcgctggcgcaagggctcgggcctgggctggctgaccgccgagtacgcgatgttgccgtcggcgacgcacacccgttcggaccgcgaatcggtcaagggccggctgtccgggcgcacccaggagatcagccggctcatcggtcggtcgctgcgggcctgcatcgacctggcggcgctgggggagaacacgatcgccgtcgactgcgacgtgctgcaggccgacggcggcacccgcaccgcggcaatcaccggcgccttcgtggcgctggccgacgccgtcacctacctgtcggcggcggggaaactgtccgatccgcggccgttgtcgtgtgccatcgcggcggtcagcgtcggcgtggtcgacggccggatccgggtggacctgccctacgaggaggacgcccgtgccgaggtcgacatgaacgtcgtcgccaccgacaccggcacgctggtggaggtgcagggcaccggcgagggggcgaccttcccgcgttcgaccctggacaaactgctcgacgcggcgctggccgcctgcgacaagctgttcgccgcccagcgcgaggcgctcaagctgccctacccgggggtgttgcccgaggggccgccgccgccgaaggcgttcggcagctgacccgcctgccggtgaccagtgtttccgtgtgatacccgcccgacatgcgcgtagcgttgtgggcttggaggtgccgcatgagcgacgacgccgaacggcggtccagagtttcgggagccgcacgtaggtccgctgatgaggcggccgagcgtgtcgcggcggcacgtgaacgtctgcatgcggcccgcctgtccgccggcgatgcccatgagcgtgccgcgcagttgcacgacagagctgccggggggggggcttcggtgacgtcgaagcccaccacaggtctgccgagcggcatcgagcggcacgggatgcggactacctggctgctgagcaggatcagtaaagcctgaggcgaatttcgttgtggcacagggaaattggtcctgcctgccgccgggcaggggttccctcgcctggtcgccctgacagattgcctagagtcgtgcaagtgcagccgacgcatgttcagggataactgttgagcccgctgctggtcgccagccgcaatcgcaagaagctggccgagttgcgccgcgtccttgacgcggccggtgtgacggggttgacgctggtgtcgctcgacgatgtggcgccgttcgaggaggcgccggagaccggtgcggtgttcgaggagaacgcgttggccaaggcccgggacgcgttcgccgcaaccggtctggcgagcgtggccgacgattccgggctggaggtggccgcgctgaacggcatgcccggcgtgctgtcggcccgctggtcgggccgccacggcgacgacgccgccaacaccgcgttgctgctggcgcaattgcgggatgtgcccgacgagcggcgtgccgcgtcgttcgtgtccgcgtgcgcgctggtgtcggcgtcgggggaggtcgtcgttcgcggcgagtggccgggccgcatcgcccgcgagccgcgcggggacggcggcttcggctacgacccggtcttcgtccccgacgatgccgcgggccgcaccgcggcacagctcagcccggcggagaaggacgcggtgtcgcatcgcggtcgcgcgctgcggctgctggtgccggcgctggaaacgctggcccgcgcgcggggttgaatcggcggccgggcttacacgccgaagcgcgccttgacgtctcgggtctggaagtgctcgacgatgatgccgagcagcgggatggtgccggacagtagcacgccgatcgtcttgccgatcggccagcgcaccttgaccgccaggttgaatgcggtcagcacgtagacgaaatagacccagccgtgcaccacctcgatccaccggatttcgtggtgcatgaccaggtgcgagacgatctcgtagcacagcgcgatgagccacagccccgtcgtccacgccatgatccggtagccgagcagcgcggtgcggatcttgtcgacggggaccgcgggcacgggcgctccgggcgtctccggtgtggtcatgtggttgtcctgttctgttgtgcggcgtcctgggcggcgagctcggccagataacggttgtactcccgcagcgccgggtcgtcgggcggctggggggtgggcctgggccgctcgggcagcagcccggcgggtatctccgtcacggcggcggtgtcgcgcggccggggcggttcctcttcgtagcgaacgaatttgcggtaggcgtacacacagaaccacgcgaacagcggccattgcagcgcgtagccgaggttctggaacgagccggagacggactgaaacctggtccactgccaccagcccagcgccaggcagccgcacgccgcgatgatcaccagagcgatcagcgcgggccggcgacggcgctttcgagggaccggggtggacacccctcgaccgtaccgctgcgcaccgctgagacggcccgggaggcgacgaggcgttacgatcgccacgccgcgggcgtggcgaaattggcagacgcgatggttttaggtgccattgctcgaaagagcttgagggttcgagtccctccgcccgcaccgatgcggtaagggaattcatgcaggtagacagcggttttcatgttctctctggccgctccgtggccgcattttggccacaactcacgagtaacttgggcgagctgcattgctggacgcgctgctcgatgaacgcgccgcggccgcccaaaccggtgttgctaggcgcggcggtatcagccgtgacgcctgacgtgcggtactagcgtgggtcatcaggctggcggggaaagggatggcgatgctcgctaggttggcccggacgcaacgtccgacgcatgcccgcagggcgacggggacaactgcgaaacctcgggcgcggctgtgcaactgaagtggttgagcgtcgccgagctgatcgcggaagccggcggcgatccgtgggcgatcaaccagagccttcaggccggcagcccctctcaatgattccgccgaagtgcagcgcctcgtcaaatcccttggcgcgcagtcggagcaacttcccaagatcggcaccgatctggaagaacatcgccgccgcgctggctgaagcgcagaaggcggggacgcaacgaatcggcttgttggaagacgagttgcagggcctcgacaatgtgatcgacgctgctgagcatgacctgcaatacggccatcccaatcatgtgggtgggcaggcaaccaccgggcacacacacagcgcccccggtggatgaggaataccgtttcagaagggaagtgacgagtgtggaccttgggagccagaatcgccgttccggcgtcagctgtcagcctgctcctgagtggctgttctgaagtgcgcaaccccatcgcgccgccgcaggcgcgggctcaggtcatcgccgccgcccgcgacatcgtccaggcgctacaccctgaagtgaccgaagcgaacttcagctacgagtcgtgtaatgaccagggcgaggcgccttttcgcggtgttgtcaacctgtcgttttggatgccaggagtgccgcacaaccaggccgtcgacccgcaagcagtcatcaagggcctcgtcgccgacaggtggagcaccgattccgacttcgtatcgcacggcgcaacgctgaagaagaacggcgtcaacgtcatcctgacgatcgcgccgcaagccgggcccagcaccgtctatcaccggcatgtgggcgccgacatcaacggcgaatgccgcgacaccaccgaccaccgcactgacggctcgacgtctcccgtcgacgtcagcaaggaaatccagcctcagtgacatgaggccgagcgggacaaacctgaccgaacgttattgctcagggacttgtgtgagcttccaggctggtcgcgacgtcatgggcgagctggtcggctaggagcctgctgaattaattccgcgtggcgggacgagttgtcctggggttttggggatgattgttgggtgcagggtcgctctgatgatcagcgtgagttgttggatgcggagtcggttgccgggcatcttctgaaggccgacagcatgtttgcgttcctggcggcgcaccgcagccagttgtttcccgaggagatgttcgcggacttgttcccgtcgcagcggggccggcccagcgtgccggctgaggtgatggcctcggtgatcaccttgcaggccctgcacggtttttcggataacgagaccgtggatgcggtgactttcgatctgcgctggaaagcagcgtgcgggttgccgatcacggcgggcgcgtttcattcgacgacgttgacgtattggcggcgtcggttggcggcttcggatcggcccaaccggatcttcgaggcggtcaagacggtggtggccgagaccggggtgttggcgggcaagacacggcgggccttggattccacggtgctcgacgatgcggtggccacgcaggacaccgtgacgcagttgatcgccgcgatccgacgagtgcgccgcgaagtccctggcgctgcagcggtgatcgaagcccactgcagcgcccatgattacgacgatccggggaaacccgcgattgcgtgggaggataaggccgctcgggatcggctggtggatggtttggtcggtgatgctcaccgggtgctgggctatctgcctgaccaggaactcgcgccgcgggctgctgaggcggtggcgttgttggcgttgatcgccggtcaagacgttgaaccggtcgagggctctgatggcaccgacgggcactggcgcatcgcgcagcaggtcagtggggatcgcgtgatctccaccgtcgatgccgacacgcggcacgctcacaagacggtgcaccgccgccaggacggcttcaaagcccaccttgccgtcgagcccgacaccggaatcatcaccgattgcgcgttgaccaaggccagcggcgcggacaaccacgaggccgtcgtcgggctgagcctgctcgagggtgaacacaccccccggtgcgggtcctggggcgattcggcgtatggcaccggggccgcccgggcggcactggccgacgccggccatgtcgcggtgatcaaaccgctaccgctacgctcgccggttccgggtggcttcaccagcgacgatttcctcatcgatttcgacgcccgcatcgtgacctgcccggctggacacggaatgccgatccgtcccagtggcggagtcaccttcgaaagatactgtcgctcatgcccgttggcgtcccggtgcacgaccgccacgcgcggacgcaaactcacccttcatatccacgagcaattattgcgcgctgctcgcgtcgcggcccgcgaccccgattggcaagccgaataccgccaacaccggcccatggtggaacgctcaatggcctggctcactcgcggcaaccgcaaggtccgctaccgaggaaccgccaaaaacaaccattggctgcaccaccgcgccgcagcactgaacctacgtcggctgctcaccatgggcctgacccgcaccgacaccacctgggccatcgcctaacacgccctcacaccaaggccttgcctcagccgccgaccgctgccacgctcaacaacggcggggcgatctcttttctgtcgacccacagggtctgactacaacacgccgctagacggttcgagacgccccgccccaaaaaatcccctaattcagcaggctcctagttccctcgacacggtgccggcgcgagttcgccaccgaaatcctgcgggctggtaggcgtcaaacacgtcctgccgggtacatggacctcacgggatatgagggagacgccatgcccaccggatacgagtcaacaccacacggcgaaaaggccgtcagcgcagaagatgtcgagctcgccgaactcagggccgcgaaggcgcgggaacgcgccgcccgcgcgggactgtcggcggcgcgcagtttcgaggaatccgccgtccaacacgaacgggtcgccaagacgcaggactggacggtccagcagggcgtgccggaggtggacatgcaccgcgcgtcggcgatcaagcaccgtcaggccgcggcggaggaccgcaagctggccgagcgcaagcgccgggaatccgccgccgacctggcctctccggcgtcggccagcgactgacgccggccagtcctcgatgaaccgggcccgcacgtcgggcgccggcagcagacgagtgtcgtacttgccgaacaggcgctaccggacgtcggcgacccggtcgtagagccagtcgcgcagccgggccggcagcggccgggcccgcaggttgacctttggtaaggcaacccttagtttgtgggtgacgtaccgagtcgtgagcggctcgccggtggtcggcgaacggggatgccacccacccgggcacgcccgggtgacgggagcggcggcgacgacgccgcccgggcgtcggatcggcgaggccggtgtccggcgcgccgcgagaaaggagcgctaatggcccgcggcctccagggtgtgatgctgcgcagcttcggcgcccgcgaccacaccgcgacggtggtcgaaaccgtccggatcgcaccgcatttcgtgcgggtccgcatgacctcgcccacgctcttcgaggacgtggatgccgaacccgccgcctggctgcggttctggttcccggacccggacgggtcgaaaaccgaattccagcgcgcctacacgatttcggaggccgaccccgccgccggacggttcgcggtcgacgtcgtgctgcacgaccccgccgggccggcgtcgcggtgggcgcgcaccgtgcagcccggcaccaccatcgccgtgatggcgctgatgggctcgtcccggttcgacgtgcccgacgagcagcccgccggttacctgctgatcggcgacccggcatccatccccggaatgaacggcatcatcggcgtcgtccccgacgacgtcccgatcgagatgtacctcgaacagcaccacgacgacgacaccctgatcccgattgccgtgcacccccggctgcgggtgcactgggtcgcccggcgcgacgagaaatcgcttgccgcggcactggaaagccgcgactggtccaactggtacgcgtgggcgactcccgaggccaccacgctcaagcacgtgcgcgcccggctgcgcgacgagttcggcttccccaagtccgaggtgcacgcccaggcctactggagcgcagggcgcgcgatgggcacccgccgcggggacgaggcggcgaccaccgacgacggcaccgaaactccggaagccattgcggcacaggccgattcgacccaacgtcagcccgaggccgcgccggtgccggcggcgcgcggaaactggcgcacccaggccgccggccggttgctggcaccgctgcgctgggcgctgatcccgtccggcgtgctgcaggcggtgatcacgctgatccaactggcgccgttcgtgctgctggtcgagctggcccggcgcctggtggccggggcgcccgccgcccggctgtgggacgtcggcatcgccgcggtgtcgctgctgggtctgggggcgttgctgggcgccgcgctcacgctgtggctgcatgtcgtcgacgcgcggttcgcccgtgaccttcgttcggccttgctgcgcaagctttcccggctgccgctgggctggttcaccgcccgcggatcgggctccatcaagcagctgctgcaggacgacacgctgtcgctgcactacctggtcacccacgccatcccggacgcggtcgccgcggtggtggcgccggtcgcggtgctggtctacctgttcgcggtcgactggcgggtggcgctggtgctgttcgtgccggtgctggtttacctggtgctgacggcgtcgctgacgatccagtcggggccccgcatcccgcagtcgcagcgctgggccgagacgatgagcgacgaggccggcgcctacctggagggccagccggtgatccgggtcttcggtggtgccgccgcgtccagcttccggcgtcgcctcgacgagtacgtcggcttcctggtcgcctggcagcgcccgctggccggcaagaagaccttcatggacctggtcacccgtccctcgaccttcctgtggctcatcgcggccgtcggcaccctgctcgtggtcgcgggccggatggatccggtgaatctgctgccgttcctgttgctgggcaccacctttggcgcacgactgctcggcatcgcctacggcctcggcggtatccgggccggcatgctggcggcccggcgcctgcagaacacgctcgacgaacacgaactcgaggtgcgcgagccgggcgagcccaccggggagtcggcgcaggcggtggtgttcgacaacgtcggtttcggctaccgccccgacgttccggtgatccacgacgtgtcgctgacgctgcggcccggcaccctcaccgcgctggtcggcccgtcgggatccggcaagtcgacgctggccgccctgctggcccgcttccacgacgtcgaccggggctcgataaccgttggggggcgcgacattcggtcgatgacggccgacgagctctacgcccggatcggattcgtgctgcaggagacgcagttggtgcacgggacggtcgcgcagaacatcgccctggcggtgcccgacgccaccgccgcgcagatcgagcaagccgcgcgcgaggcgcagatccacgaccgcatcatgcggctaccgcacggctatgacaccgtgctgggcgccggcgtcgggctgtcgggcggggagcggcaacgcctcaccatcgcccgcgcgatcctggccgacaccgagattctgatcctcgacgaggccaccgcgttcgccgatccggaatcggaataccttgtgcagcaagcacttaaccgcttgacgcggaaccgcaccgtgctggtgatcgcccaccggttgcacaccatcacccgggccgaccagatcgtcgtgctcgaccacggccgcgtcgtcgagcgcggcaggcacgaggaactgctggccgccgacggtcgctaccggcggctgtgggagggcggtcggcgcgacgcggtgaccgtcggcacggcgggggaggttgcccgatgattcgcacctggctgagcctggtcccggcggaccgccgcaacaaggtcgtcgcctacaccgtcctggccctgctgtccgtcgcggtgcgcgcggtggccaccgttctgctggtgccgctggtgggcgcgctgttcagcggcaccccgcaccgggcgctggtctggctgggctggctgaccgccgccaccgcgatcggctgggcgatcgacaccgccaccgcgcgcatcggcttcaacctgggtttcgcggtgctcgaccacagccagcacgacgtggccgaccggctgcccggggtgcggctggactggttcaccgccgagcacaccgcgacggcccggcaggccatcgcggccaccggcccggaactggtcggcctggtggtcaacctgctcacgccgctgatctcggcggtgctgctgcccgccgccatcgcggtggcgctagtgccggtgtcctggcaactggggctggccgcgctgggcgggctgccgctgatgctgggcgcgctgtgggcgtcggcgcgcctggcgcggcgcgccgattcgactgccgccgaagccaatagcgccctcaccgagcggatcatcgagttcgcccgcacccagcaggcgctgcgggccgcgcggcgcgtcgagccggcgcgcagcctggtcggcgacgcgctggccgcccagcacggcgcgacgatgcgcctgctggccatgcaggtcccgggccagctgctgttcagcctggccagccagctggccctgatcctgctggccggggccgccaccgcgctgaccgtcaacggcacgctgacggtggccgaggccatcgcgctgatcgtcgtcatcgtgcgctacctcgagccgttcaccaccatcagcgagctggcgcccgcactggagagcacccgcgccacgctcgacaacatccgcgccgtgctcaccgcgccgcaaatgaacgccggctcggcgtccctgccgggcaccgcggcgccgcgcatcgagttcgacgaggtcgtcttccgttacgacggggcgagcgcgccggtgctcgacggggtgagcttctcgttggagccgggcagcacgacggcgatcgtcggaccgtccggatcgggcaagagcaccattttggcgttgatcgccggactgcacgagcccacccggggccgggtgcgcatcgacggcgtggacgcggcgacgctggacgccgaatcccgccgcgcggccagcagcgtggtgttccagcacccctacctgttccacggctccatccgcgacaacgtgctggccggtgatcccggcgccggcgacgacgcctacgcgcgcgcggtggcgctggcccgcgtcgacgagctcgttgcacgactgcccgacggcgccgacagcgtggtcggggaggccggctcggcgctgtccggcggtgaacgccagcgcgtcagcatcgcccgcgcactgctcaaaccggcgcccatactgctggtcgacgaggcgaccagcgcgctggacaccgagaacgaggcggcggtcgtcgacgcgctcaccgccgacccgcgctcgcgtacccaggtcatcgtggcgcaccggctggccagcatcgggcacgccgaccgggtcctgttcctggacgacggacgggtggtcgaggacggaacggtcgacgaattgcgtgccgcgggcgggcgtttcgccgaattctggcggcagcagcacgaggccgccgaatggcggattccggccggttagctcaccgcggttgaccgcaactcttgcggtatgccttacagtttgtcagtcggatctgcatccaggaggcgtgccgcgatgagtgctgtgctgtcgataccgcgttaccccggtgacgtcaccccgcagtggctgtcggcggcgctgagcgggcgcggagctcccgtcgaggtcgccgaggtggacgtggccgcgatcggcaccgggcagaccggggccacctaccgggtgacggcccgctacgccaccgatcccggtgacctgccgcagaccttcgtgatcaaacttcccgctcaggacgacaccgtgcgcgaccgggtggtcatcggctaccgcagcgaatgcgcgttctactcctcggtggccgaccgggtgcaggtgccgacgccgcgctgcttctactccgagatcaccgaggacgcaatggatttcgccctgctgctggccgatcaggcgccggcggtgcagggcgatcagctgttgggctgcggtgaaaccgaggcgcggcttgcggtcaccgcgctggccggtctgcacgcgcccagctggtgtgacccggtgtggctcgatttcccgggcatcgcgttcgggcggcccgacgaagccggggcgggcggcatgggggaggtggcgaagatgagcgccgacatcacgctggagcggctgggcgatcggatgagcgccgaagaccgcgaaaccttcgccgcggcaatgggtgtgatcgcgccgtggctgctgtccgagtatgaccggttcgccctgctgcacggcaactaccgcctggacaacctgctgttcgacccggaccgaaccagggtgagtgtggtcgactggcagacgctcggggtcggccttccggcccgcgacctcgcctacttcaccgcgaccagcctggattcgccgctgcgcgcggccatcgaggaagagcttgtcgccgactaccaccgcgcgctggtggccggtggggtcagcggctacaacctcgaaacctgttggcgcgactaccggctcggggtgctgcaggcgccgctgatctccgcgctggggttcgcgttcgccgcggccaccgagcgcggcgacgacatggtgctcaccatgctgggccgcggctgccgggcgatccgcgagctgggcaccctcgagctgatcggctgacgcctcagaggtcgccggtgaagtcggcgctcagccagcggtcgggccggatggtgaacagcacctcctcgacaccctccaggctttgcacgaacgcgcgcccaccgtcctcgcccaggtaacggatggcgacggccaattgcacgtcggacggggccggcttggtggcgtcgacgacggtgccctccaccaccacgtattgatacggcggctcctcgcgctggaccaccacagtgaccttgcccgcccgctcgatgagccgggccttgcggctggacgccccggtcatgatccggatgtcgccgccgggggtgtagtcgtaccagatcgggacggcggccggcgggcggccgtcggtggcctcgaccgataggaccgcgacgtgtgtgccggcgaggaactcctggcgttcggattcgctgaagggtttcatgtggcctgcaagtgcgcggcgcgcgcgatctattcccggggccggcgctcagtactgggtcgagccctgatcgaccgggatctgggcggcggtgaccttgcgcgattcgtcgctggccaaccagcacaccgtgtcggcgatatcctccggctcggcgacccagtcgggcaaaaacggtgtcagcacgtgcgacagctgcgggttggtctccatggcctggcccaccgcggtgaccatgtcgcccgagcccatcggcgtgttcaccggtccgggatggacgctgttgacccggatcgaatgcttgcccaactccgcggcgaacgcccgcgccagcccggtcaccgcgtgcttgctggccgtgtagtgaatcatgaacggctgcatcttcattccggccgccgaactgatcaggatgatggagccgccgcggccgccctcgatgatccggggcgcgccggccatcaccgtgttccaggtgccggtgacgttgatgtccatgacgtcgcggaagtcttccggggtgatgtcgtcccaggcctgcggggccgcgaccccggcgttggcgacgatgatgtcgaggcgccccaacgcggccacgccgtcgtccaccacctttcgcagcctgtcgaagtcgcgggtgtccaccaccgcggcgacgatccggcggttcgcggcctcgaccaggcgcacggtttcgctcaggtcgtccgggctcgccggatcgtaggggacacacgagggcagcttgccggcgatgtcgacggcgatgatgtcggcgccctcggcggccatcctgaccgcatgcgcccggccctggccgcgggccgccccggtgatgaaagccactcgcccctcgagctttccggccatcagcgctccttcgtagtagtggctcgctgggccgccttgacgaggttcgacccgatgatcagacgctggatctcgctggtgccctcgtagagccgcagcaggcgcacgtcgcggtagatgcgttccaccgggacaccgcgcatgtagccgctgccgccgtgcacctggaccgcgagatcggccacccggccggccatttcggtgcagtacagcttggccgccgacggcgccacgcggcggtcctcgccggtcacccacagccgggcggcctcgcggaccagcgcgcgcccggccagcacctcggtctgctggtcggccagcatggcctgcaccagctggaagtttccgatcggcgtgccgccctgcgtcgcggtggcggcgtaggacaccgattcgtcgagcgcgcgttgcgcggcgccgaccgcgagggcggcgatgtgcacccgtccgcgcgccaacgaggtcatcgccgcgcgatacccgatgttctcgctgccgccgatcagcgcgtcgcccccgacccggacgtcgtcgaagctgacatcggccgtccaggcgccctcctggcccatcttggcgtccttggcgccgacctgcacacccgccgcgtccgccggaaccaggaagacggcgattccgggtccctggtcgtcggccggccgggtgcgggcgaacaccacgaacaggtcggcgacgggcgcgttggtgatgaagcgcttctgcccggagatcacccaattgtcgccgtcggcaacggctttggtgcgcaggccggccgggttggacccggcgccgggttcggtcagggcgaaggaggcgacgacgtcgccggccgccatcggctcgagccagcgagccttttgcgcctcggtgccgaagccgaccagcacttgaccggcgatgccgttgttggtgccgaacatcgaacgcagcgccagcgaggtgtagcccaattccatcgccagctcgacgtcttgcatcaggttgaggccgagcccgccccactgctgggggatggcgtacccgaacagccccatcttcctggcctggtcgcgcaggtcgtcgggcactcggtcgccgtccaggatttcctgctcgcgggggaccacggcggtgcggacgaactggcgggtctgggccaggatctcgccgaaatcctgctccgagacctcggcgacttcagcgctggtcatctgcggacgctccctcttctggcacctgtctggtcgggatccctgcgccgcagggggcgggcccctccgtcggcccgggccgggtacccggcatcgggtcagatcctatatgaaatatgatattcggacgtcgggcacccccggccgggggccaattcaagggaggcgtggtacaggtgtccttgctcagtggtcagaccgcggtcatcacaggtggcgcacaaggtttggggttcgcgatcgccgaacggttcgtcgccgaaggggcgcgggtcgtcctcggcgacgtcaatctggaggcgacgcaaaccgcggccaaacagctgggcggtgaccaggtggcgctggccgtgcgctgcgacgtcaccaagtcgtccgaggtcgaaacgctgatccagaccgccgtcgagcggttcggcggcctggacatcatggtcaacaacgccgggatcacccgggacgccaccatgcgcaagatgaccgaggagcagttcgatcaggtcatcgccgtgcacttgaagggcacctggaacggcacccgattggcggcggcgatcatgcgggaaaacaagcgcggcgccatcatcaacatgtcgtcggtgtcgggcaaggtcggcatggtcggccagaccaactactcggcggccaaggccggcatcgtgggcatgaccaaggcggccgccaaggagctggcctacctgggtgtgcgggtgaacgcgatcgcccccggtttgatccgctcggcgatgacagaggccatgccgcaacgcatttgggactccaaggtggccgaggtgtcgatgggccgggccggcgagcccagcgaggtcgccagcgtggcgctgtttttggcctccgacatgtcgtcgtacatgaccggcaccgtcatggagatcacgggcggccggcacctgtgagcgcggtccgcgaagccgtcatctgcgagcccgtccggacgccgatcggccgctacgggggaatgttcaaggcgctcaccgccgtcgacctcggcgtcgcggcgctcggtgggctgttgcagcgaaccgggttgccccccgaggccgtgcaggacgtcattctcgggcactgctatcccagcagcgaggcgccggcgatcggacgcgtcgtggcgctggattccggtctgccggtgacggttccgggcatgcaggtcgaccggcgctgcggctcgggactgcaagccgtgatccaggcctgcctgcaggtgcgcaacggcgatcacgatctggtcatcgccggcggctgcgaaagcatgagcaacgtcgccttctactccaccgacatgcgctggggcggcgcccgcagcggtgtgcgggtgcatgacgggctggcccgcggacgcaccacggccgggggccggcgctacccggtgcccggcggcatgctggaaacggccgagaatctgcgccgccagtacggcatttcccgccaggagcaggacgagctggcggtgcggtcacaccagcgcgcggtggccgcgcagaaagacggcatcctggcccaggagatcatcgccgtcgcggtgcccacccggcacggcgacgagctgatcgacaccgacgaacacccgcgcgcggatacctcggtggagtcgctgagcaagctcaaacccgttctgctggaccaggatccagaggccaccgtcacggcgggcaacgccagcgggcagaacgacgtggcctcgatgtgcgtggtgaccacgccggagaaggccgacgagcacggcctgaggccattggtgcggctggtgtcgtgggcagtggccggggtcgcccctcacatcatgggcatcgggccggtcccggccaccgaggtggcgctggccaaggcggggctgtcactgtccgacatcgacctcatcgagctcaacgaagcctttgccgcgcaagcgcttgcggtgatgcgggaatggaagttcggcgccgccgaccacgaccgcaccaatgtgcacggctccgggatctccctgggccatccggtcggcgccaccggcggccggatgctggccaccctggcacgcgagctcacccgccgccaggcccgctacggcctggagacgatgtgcatcggcggcggccagggcctggccgccgccttcgagcgggtcgcctgagatgaccgatccgcggctgcccctgcacggcctcagtgtggtggaggtgtccagcttcgtcgccgcgccgttgtgcggcatgacgctgagtcagctcggcgcggaggtgatccgggtcgacccgatcggcggcgcttccgacgtgcaacgctggccgctggcggcggacggcacgtcgatctattggaccgggctgaacaagggaaagcgttcggccaccatcgatttgcggtccgccgagggccaacggctggtgcagcgactgatcgtggagggcgacggcgtcgtcgtcaccaacgcggcgggcctgtcctggctgagccacgatgcgctggcggcgctgcgcgccgacgtcatccacgtccagctactcggtcgcggcgacggctccaccggtgtggactacaccgtcaacgccggcatcggctacccgctggtcaccggcccggccgagcacgccggcccgatcaaccacgtgctgccggcctgggacgtgtgctgcggactgtatgccgcgctgtccgtcgtcaccgccgtccaccgccgcgagcagtccggggccggcgcgcggatcagcctggcgctggaggacgtcgcgctggccaccgcggccaacctggggttgctcaccgagccgcaagtcgtcggcacccagcgcgaacggttgggcaacgccatctacggccagtacgggcaggacttcaccagccgcgacggagccaggttcatggttgtcacgttgaccggtcggcattttcgcgacctgctcgacgtgacgggcaccggcgcggcggtgtcggcgctcgccgatgcgctgggtgtcgacttcggctccgagggcgagcgctaccggtaccgcgacgtgctctccggtctgttcgccacctggttcggcgatcacaccgccgacgaaatcaccgccgcgctgtcgcacaccaccgtgctcttcgagcggtaccgcaccttcgccgaggtcgcggcggggccgaaagtcactgccaatccgctgttttcccgattgcaccaacccggcctgggtgactacttcgcgcccggattgccggccgcgttcgacggcacccatcccgccggcgcgcccgcccccgccctggggcaagacaccgccgaggtcctcgcgcggctggggctcaccgccgcggacatcgagcggctggccgacgccaagaccatcgcctgctgagcaaccgaagggaacgcagcacatgaccagactggcccaaaccctcgggttgaccgaattccagaccgagatcatcgccaccgtacggcaattcgtcgacaaggaagtcattccccacgccgcggaactggaacgcgccgacacctacccccaggacatcgtcgaccagatgcgcgacatggggctgttcgggctgatgatcccgcaggagtacggcggattgggcgagtcgctgctcacctacgccctgtgcgtggaggagctggcccgcggctggatgagcgtgtcgggggtgctcaacacccacttcatcgtggcctacatgctgcgccagcacggcaccgacgaacagaagcagcgcttcctgccgcggatggcggtcggcgagacccgcggcgccttctcgatgtcggagccggagctgggctccgatgtggccgcgatccggacccgcgcccggcgcgatccggacggcggctacaccatcgacggccagaagatgtggctcaccaacggtgccacctcgacgctgatcgcggtgctggtgcgcaccgacgagggctcggacaagccgcaccgcaacctgaccgcgttcctggtcgagaagccggtcgggttcggcgaagtcgttgcgggcctgcggattccggggaagatcgacaagctgggctacaagggcatcgaaaccaccgagctcatcttcgacggctaccgggcggccgccgacgacatcctcggcggcacgccggggcagggcttcttccagatgatggacggcatcgaggtgggccgggtcaacgtctcggcccgcgcgtgcggtgtcgcgatccgcgccttcgagctggcggtgcgctacgcgcaacaacgcgagaccttcggcaagccgatcgccgagcaccaggccatcgcgttccagctggccgagatggccaccaaagtcgaagcggcacacctgatgatggtcaacgccgcacgtctgaaggattcgggggagcgcaacgacgtcgccgccggaatggccaaatacctggccagcgaatactgcgccgaagtgacccagcagagtttccggatccacggcggctacggctattccaaggagtacgagatcgagcggctgatgcgcgacgcgccgtttttgctcatcggcgagggcaccagcgagatccagaagaacatcatcagtaagcggctgctcgccgaataccgggtgtaggcaacgatgagcgttccggatttcgcggcccgaccgcaactttccgacgacgtcgcgcatctgatccgcggccggatcttcgacggcagttacgccgccggctcctatgtgcggctggatcagctggccgccgaactcgggatcagcgtcacaccggtgcgtgaagcgctgttcgcgctgcgcgccgagggcctgatcagccagcagccccggcgcggcttcgtggtgctgccggtcacccggcgcgacgtcaccgacgtggcgaacgtgcaggcgcacgtcggcggtgagctggccgcgcgtgcggcggtcaacatcaccgacgaccagctgcgcgagctcaaacagatccaggcgcagctggaggacgcctacgccggcgacgagcacgagcgcaccgtccggctgaaccacgaattccaccgggccatcaacatcgccgccgactcacccaaactggcgcagctgatgtcccaaatcacccgctacgcaccggaatcggtgttccctgcgatcgagggctggcccgagcagtcgatgaaggaccaccggcgcatcttgtccgcgctgaaaaagcgggacgacaagctggcccgtgcggcgatgtcggagcacctggccgccggtgcggttccgttgatcgaccatctggtcgcccgcggtgtggtggtcgacgccggcgggccggaccccggttgacgccaggcctgttgtctttgtggacgggtgcggcatacgctgcgacctaagggggcaacagaacggagcgaggaaggatgttcccgacgcttcgcgcatcggcggtgctcgttgtctgtgtcgcggcgatcgccacggcggccccggccttccccgacccgatggatcccattcccggcaacggtgttttcgtggtgggccccgacatcgccccgggcctctaccacacgggcggctcaggctcggccttcggggtctggatcaacaacgtgccgacccaggactcgatgtgctcgtggttcacctacagcacggcggacgcgaacaaagagcatgtgctgcagacgaatacctcgatcggcccgatgtatgcgaacatcaactccgcggtcaaggcgttcgagtcgcagaactgtcaaccctggacacgggtttcctgacgccggtcggcgtcggcgagcagctcccgcagccggcgcacgtcgaccttgccggtgcccccgcgcggcaggtcgtcgtcggatcgcagcaccagccacacggtgggaatcttgaaggagctcaacaggtttcgcgcggcggcgcgcagttgtgcggcggtcaactcacggcacaccaccgccgcgcccacccggtcacccgtggcgcccggcacattggtgacgacggcgctgtccaccccgtcgatggtgcgtagcgcgcgctcgacctcgctcgggtagacggtggcgccgctgaccttgaacatgtcgtcggcgcgcccgtggtagaacaaaaagcccgcgtcgtcgagatgacccaggtcgccggtggggtagaagccgtcgacggtgaacaactcttcgcggctgcggccacacatgccgcgcagcgtgtgcggtccccggatctggatgatgccggcggttccggccccgaccggcgcgccggtgtcggggtcgacgatgcggacttccatgccgtcgaacggctttccgcagctgccccacgccgaaacgggcatgtcggtgtcggcggggtaaccgcagtacgggccgaacgcctcggtcatgccgaagagtgtggcccgggcgcccggtcgggcgcgctgttcgggcggcagcagggcttgcaggcttccgggccgcagcgccgagaggtcggcgccgacggtgccggcatgcctggccagggtctcggcctggtccggccagccccgaaacagcgtgacccgttcgctttccagcaatcgcagggtggtctccgggcgagggatttcctcggtcaccagggtggcgccggccagcagcgcggacagtattccgctgccgaaaccgcccacccagaagaacggcatcggcagatacagacgggagtcggcgtcgatgcagcgggccgcgaggccggattgcaccgcgcccagcgcgctgccgtgtgagtgccagacgcccttgggcgttccgctgcttccggaggtgaacatgatcaccagcgggtccgcgggggtgacggtttgggtcatggcatcgacgatctggcctgcccgcgcgccggccgcggcggcgtcgagctgttcgttcggccaaacctgttgcagcgctggcagttcggaacgcgccgccgcgacgtcgtcgaggtagcggtgaccgcggaattcgtccacgctcaccaagaactgcacggcggcgacccgcaactgcgcgacgagttcaccggctcgcagcagcgtgctcagcggtaccaggacggcgccgatgcgggtcagggcgatggcgatcagcacccaacgggtgttgttgggcatgatcaatcccacccgggtgcccttgccgacgccggcctgcacgaacaccgcggcgagttcccttgtggcggtgtcgagttggtcatagctgatgcgggaacccgggtcgatcaccatcggcttgccgccgaactcggcggcgcgtgacctgaccaggtgatcgatggtgggtgcgctcgcctcaggcatcgaacagcttcctcagttgccgcaggtcgaccttgccgctggacagcagtgggacgtcggcgcggcgcagggaagcgaaccgccgggggatcttatacgccgacagttcggatttgagtcgttcgcgcagcgcgtccggatccagggcggcccggtcatccggccacaccaccgcggcggcgaccagctggccgcgccgggcatcgggaatcgcgaccacgtaggcggtcgcgccgccggtgaccgccgcgatcgccttttcgacctcgaccgccgagacgttggcgcccgcggtcttgatcatcgcgcccagccgcccggcgaaatagaagtatccgtcggcgtcggcgcgcaccagatcgccggtgtggaaccagccgtcggggtcgaaacactcttcccggctccgtttgtggtaccgctgcatcagatacggcccgcggatgcacagttcgcccaccttacccaccgcgacggcggccccggtgtcggggtcgaggatcctggcctcgaacccgggcgcgggtttgccgaacgagccgcgccggtgctcgggctggtccgcttcgtcgtcgccgatcaggaccaccccgccggcctcggtcatgcccagcatgttgtgccgcagttcggggtcggcggggcgcgcctcgaccgccatgatcggatacaggttcccccgccgcatcgacgacagatcgcggtcggcaaagctcgggtgctcggccaggtgggcgatccccgcgctgaaaccgttggtcatggtgggcttttcggcttccagcaggtccagagtcgccccggcgtcggtggcgttggagcatatcagcgtcgatccggccaccagtgtggccagcagtccgaaggcgaacccgccgatccagaagaacggtgaattgcagaacaatcggtcgtctgccgtcaaaccccggattccgttgaggttgcgctggtgttccagcagcgcaccgtgggtgtgcaccacccccttgggggtgctggtcgacccggaggtgtacacgatggccagcggatcgcacgcctgcacgtcgtcctccatcgcggccagcagtgccgggtcgatgccgccgcccggcgcgcccaccgtctgcggggcgaacagcacccggcgcaattgcggcgccgcggtgcaaaacaaccgacggccgggatcgaagtcggtctccgacaccgcctcggacaagcgccgcgcatagtcgtgcgagcgaaaggagcgggcgctcaacaggatctcgacgtcgctgtcgagaagctgctcgcgcagctcgcgcgcggtgacgaacgtcgagaacggcaccaccacggcgccgatccgggccgccgccagcatcgcgacgacgaaccgcgcaccgttcgggtggagcagcccgacatgcgttcccttgccggcgccaagggcgatcagcccccgggcgagttcggccgatcggacgtcggcctcggcgtagctgatccgttcggcgtcgcagatcagcagcgggtggtcgccgcgccgccgcgcctggtgccgcaacgtcgcgccgaccgtcgcgaaatcaccgggcatggttgcgcagtaccgtcggccgctcggcgaagtagccgcggaccgcggccaggtcggccttgccggacggggttcggggcagggcgtcgacgatcgcgatctcggtgggaatctcgtagcgcgccaagcgctctcggagatgctggaccagtgcgtcggtcgtcgacggcgcgcggagttcgaccatggccaccggcgtctctcccagtcgtgggtcgggccgggcgacgacggccgcaccggcgaccgcggggtggctttccagcgcggcgcgcacgtcgtcgggcatcaccttgaacccgccgcgaatgatcgcttggtcggcgcgcccgacgatccagacaaacccgtcggcgtcgatgcgcgccatgtcggtggtgcgcagccagcccgcgtcgggccccagctgcccgggcttgacctccagcagcccgatttcgtccggccccagcggtgttccgtcctcggcgaccacccgcagcgccgcgcccgggttggcccggccgacactgccccgtttgacccgccagtaccgccggtgatcggcgagggtccagcccgccacgccgccaccgaattccgttgccgcataagaggtcagcaccgggatgccgtacttctcggtgaacgcgtcggcgtcgtcggccgacagcggcgcggtgccgcaggtgacgacctggatgctttccagatcggcgcgcggcaggtcggagtgcagcaccgtgcgcagcgcggcgggcaccagcgacaccgcgcggggccggtgcctgcgcacggcggcggtccaggcgttcagctcgaagcgttccagcaacacgaatggccttgcctcggcgacgcattgcagcacgcggaacaccccgccgatgtgcaccagcggagagttcacgatggcgacgtcgcgccgcggttcggtgggcgccggtgcggtgcccggctcgacgcccagcacgctgcgcgccagcatgtcgtagcccaggtcgattcgcttcggtgggccggtggtgccgctggtcaacatgcgcaccgccacactgcgcggcgcggcggcgggcggggcggccggccccggcgggtcggcgaggcgcgagatcggcatcgtcggggtgtcgtcggtcaccagggcggccagatcgtcgggctcgccgatgatcaggggcagccgcagccgcgccaggtcggccctggtgcgctcgtcgccgcgggacgggttgaccaccacgacggttccgccgcccagcagcacgcccaggaacgccgccacctgccagggccggttgcgtagcagcatccccacctcggtgccggtggtgcgagcggccacctgtcgcgccgtcgcgcccagctgtgcccaggaaaaccattggccgccatactcgatggcgcggccgtgcgggtcgaggtcgagcacgtcggcgatgcgctggacgaggggatgacgcggcatcagcggatcttcggtgtgcgtgccgcgccgcgtgcaccggcgtcccggccggcggccagctcggcggtgcccagcggattgcccagccgggtgtagatgaggccctgctccatcgccgcgcgatacggcttgtccagtgattcccagatcgccttcaccgtgcccgcggtcgcggtcgggggcttggcggcgatggtcgccgcgatctcgtgggcccggtcccagagccgttcggcgggaaccacttccgtcaccaggccgatccgcagcgcggtgtccgccccgacccgttcgtcgttgcccatcagtgcgatccgcaacgtctcgccgagcccgatgcgacgcatcaggccgaccggttccagggcacagaccaggccagccgacacatgcgaatcgaaaaaggtggcgtcctgcgagcagatgaccacgtcggactcgttgacgaagtagaacgcgcccgcggtacacatgccctggaccgcgcacaccaccggcttccacatcttctgccacttcgggctcagggcttcgccgggatcctcgtggttccagatgttttcgggctgaccgtacggcgtcttgatgtccagcccggcgctgaacgcccggtcgccggcggcccgcaacaccaccgcgtgcaccgcgtcgtcgagcttgaccaggcgccacgcctgagccatctcggcacacatggcgcggttgaacgcgttgagctgctcgggccgattgagcgtgatggtggcgacgtggtcggtggcgtccacctcgagcaggatggtgtcgaactgtgcgctcatcggcattgccaattcggttggcgcttttccacgaaggccctcggtccttcggccgcgtcctcggttcgcaacacccgctcgcggaaggtctcggcgaggatctccgcctcgtgcagcggcacgttcaggcccttgaggatggccagccgggtgccccgaacggccagcggcgcattagaattgacgatgtcggcgatctcgtgcgcccgctccagcagccggtcgtgctcgacgatctcgctgatcagcccgagctcgtaggcgcgctgtgcgctcatccgctcgtgcttgcccatcaacgccatccgcagcgcgatcgagcggggcagcacccgcgacacccggaccaattcacggccggccaccaggccgatgctgacgtgcgggtcgaagaaggtggcctgctcggacgcgatcacgatgtcggtcgtcgtgacccagtccatgcccgcgccgcaacagattccgttcaccgcggtcagcaccggcttggccatggtgcgaaacggcggcgtcccttcctgcggggcctcccattggtcgtaggtcgacaggtacggccgctcgtagatcaccttgccgtcttcggggatctccttgacgtcggcgcccgagcagaacgcgcggccggtgccggtgacgacgagcagccacaccctgtcgtcgttctccgcctcgtggtaggcggcccgcagttcggtgatcatgtgcgggctgagcgcgttgagggcgtccgggcggttcagggtgatggtcgcggtgtgcccgtcgacctcgtacttgatcgtgtcgaacgaatcaacgggcatgagtcatcccttcgtatcccggcgccaccgagcgtgggccgtatatacgggtgggcgccgcttttcgtgcatggcgcccacgctcgacgccccggcgcctgtagtcagcggccacggaaatccgggtcccgtcgctgccggaacgcctccaggccttccttgaaatcacttgttcggcaagataattccagattgaacaactcctgggtcagcgactggctcagcgttgcgtgctgaccgaagctcagcgcctgcttggccaggccgagcgcggcggtcggtccggcggccagccggcccaccaactcctcggcggcgtcgtcgagttcggcgccgccgaccgcccggtggatcaacccccagtcggccgcgtcgcgtccgccgaccttctcgcccagcagcagcatccgccgcgcccgcgccaggccgaccagccgggccagcaaccaggtggatcccgagtcggggctgaatcctcgctcgacgaaaggctcccagaacaccgcatcggcggcggcgacggtgaagtcggcggccagcgccagattgcagccgaaccccaccgcccagccgcggacactgcacaccaccggcagctggatgccggcgacgagctcgatcacccggtgcgcggcgtgggggatgcggcgcaccagatcaccggcgcgcgggcggggcccgcccggatcgttgacggccacccagtcggcgccggcgcagaagtcgtccccggcgccgacgatgtgcacggcgcgcagcgaatcgtcggaggccgcggcggtcagcgcatcgaccagtgtggcgatcatcaactgcgtcaacgcattacgccgcgacgggcgatcgagcgtgaggcgcagcaccgcaccctggcggtgcaccgccaccgaaccctcggctgcggccgcgtcggccccctgactcaccgtcgaatccggcctttcttcaccgatacggttacccatacagtaggcaatacgattgatacgctgtataagttagcaaggatacgctgcctgcgaaacaaccccggtgacagcgcgacccgcgcgggcggcgacgcacagcgaagcgacgaggaggagcggcgccgatgacgatcgaggaggggcaggccgcacccgcgtcggcgcccggcggtgacgcccggttcggcgaggcgccgcttgcccagacggtggccgcggccgccgccatccggcggctcagctcgctgctggtgtccctcgaacatccgcacccggcggtggacgccatgctggcgaagttcaccgagtgggagagcgaactgtcggccgcggcaccggcggacaacgcgccgcgcatcggggagatgcccgatgacccgcggcgggtctatctgaaccacgccaccgacatcggtgcctacaacccgtgtttccccgagtaccggttcaccgggctggatgccgaaaaggcaacggggcgtgtggacttcccgctggtctacgaagggccgccggggctggtgcacggcggattcctggccgtgttcttcgactgcgttatccagcaccataattgcgtcaccgggcggtccgggaagacccgctccctggccgtgacgttccgccggccgacgccggtgctgaccgagttggcattcgacatcactcggtcgcagggcgaacggggcatcacctcgaccgcacggctgttgctcggcgacgacgtgctgtgcaccggcgaggtcaacacgttggcgtcgcgcccggatcagctcgccgggtcgcgattcggccggcgccgaaaggagtccgacacatgaccgcctcgagcacctccgacgatcgcgtgctcttcgacgtcgacgccgagcaccgcatcgcgacgatcacgctgaacaatcccaagcagcgcaactcctacgacgccgccatgcgcgaggccatcgcccgctgcctggatcgcgtcgccgaggacgacgatctcaccgtcgtgctgctgcgcggggccgagggggtcttttccaccggggccgacatgaacaacgcctacggctggtacggcacgtcacgcaacgcggacgagtccacccggcgccgccccagccagcgtcggcgactcacggtggaccgcaagtcttttggcttctaccacaatttcatgggcttcccgaaggtgacggtcggcgagatcgccggctacgcgctcggcggcggcttcgagatggcgctgatgaccgacatctcggtgatcgcgcgggacaccaagatcggcatgccggccacccgcttcctgggccccgcgctcggcagcctgcacatgttcttccaccggctggggccggtgctggcccggcgcctgctgctgaccggcgacatcatcgacgccgggcaggtcgaacacctcggaatcttcaccgacacctgcgatcccgctgcggtgacggcccgggcgcgctactgggccgagaaggcggcgaagatgcccgccgatggggtggtgatcgccaaggaggccttccggctggtcgagcagagccaggcatatcagggcgaggaggtcgccagctatctgttccatgccttcggcaccaacctgcaattcgccccgggggagttcaacttcgtcaagtcccgcgccgagcacggcgccaaggaagcgttccggcttcgcgacgagcacttccacgtgccggaaccggaggcgtgacaagccttttcgggaacggtcagcgattcgccggcgccttggtgcggccccgcgcggccgacgacttggcgggcttgcgctgtcgcgagggcccggccttagcgcccttaccctcctcgatcagccggctggcgtggtcgaggatgcaggtcagcccgtactcgaaattggtttcgtcgggcgccccgatgcgatgaccgatccgggtcacttgagccagcagcggggtcttttccggatcgatggcaacggcgtcctcgatggcgcgcggcccgacgtcggacgactggttcttttcgtagagccgttgcagcaccaccgaaccgcgcacgtgaacggagatcgccgagtaggtgtcgaacgcgtcctccggtgacaggccggcctgcaccagattggccaccgccttttccatctcctgggcccccagccgcgccgccttggggctcagcgccgcccgaatcagaatcaggtcgcacagaatggggttgcccatgaaggtcttacgcatcaaacgggcgtgatttcgcaacgtctcgcgccagtcgctggcttcgacgtagggagtggcgaacacgtacttgctcagcgcgcggtcggtcatcgcgttgagcaggtcgtccttcttgcggaagtaccagtagatgctcgtcacaccgacaccgagatgtttgcccagcagcggcatgctcaggttgtcgatcgacacctgctccgcgagttcgaaagcgccggtgatgatgtcatcgggattgatggacccgcgctcgcgtcgttggcgcttgtcggcggttgcctgttttgccactacgggcacctccatcaaaatctgttccgtgcatgcggtccggcggcggcgcagccggtaaactcgaatttaccggctcctcggttctgacctgcgtatacgcttacgtgtcgcaatttccctctgctactgtaatacctatcgtaggctttttggtaaatcggctggacaggcgaaaatgaccaggctagagcaatggatctagggctggccaatgccgccgcggtggtggtcggcggcagccgcgggatggggttggcgacggcgcgctgcctggccgatgagggcgcgcgggtcgcggtgatcggccgcagccgcgacgccctcgactcggcggtgaccgatctcacccgacgcggcagcccggacgcgctcgggctggtcgccgacatcggcgacgacgccgcggtgggccaggcgttcggcgagctcgcgcggcgctgggacggcgaactcaatgctctggtgatcacggtggggccgggcgcggccggcacgttcgaggacctgaccgacgagcagtggcgccaggccgtcgaggacggggtgctgggcatggtgcgctgtgtccgtgcggcacttccgctgctgcgcaaggcgcaatgggcgcggatcgtcaccttctcggcgcattcgacgcagcgtcaaagcgtgctgctgcccgcctacaccgcggccaaatcgatgctgacgagtgtttccaagaacctgtccctgctgctggccaaggacgagatcctggtcaacgtgatctccccgggcagcatcgcgtcggaatcgctggtgggctgggcgaattcggtgggcgtcgacgggcgcgacccctacgccctgatggaggcgatcggcaagcatttcggtcatcccgcgcacatgccgcgcgccggtctgccggaggagatcggaccggtcgcggcgttcctggcctcacgacgcaactcctacatgacgggcgccaacatcaacgtcgacggcggttcggacttcacctgaaccggcggtgaaagaaaacgattggcagacaaaaggagtcgactgtggctacggcagcagacgcgcgcgcctgggcgcgcggcgcattgcgggggatcggtgactccctctacaccccgttctgcggaccggacggcgacgacatcgactgggacgcctaccgggaactggtgcgctactgcgtcggcgatctcggccacccgatgttgtggtgcaccagcggcatcgccgagttctgggccctgaccctcgatgagcgaaaacgcctgctggaagtggcaatcgaggaaggacgcgccgcgaatcccgacgtggtgatccaggcctgcacggcggccatgtcggcgaaggactgcgtggagttgacgctgcacgcccagcaggtgggcgccgacatcgcctacatccagacgccgatgatggaggcccacggcggcgagggcgtgttgcgattcttcgagtatgtggcggcgcgcaccgacatcgccctgggcatgttcaactcgccgtcgtcgggctacgtgctgacgccggccgaaagcgcccggatctatcacgaggttcccgcggtgtgcgccaccaaggaaggcgccttccggccgggggccagccggctgctgcacgagctggcacccggcctggtgctctgggagtgcgacaagacggtgtaccgcgccgggtggctgcgcgacgggatcgtgtgcccggcgcagctgggtaccgccggctacctgttcgagaccccgcagcgccgattgttctccgaatattgggatttggtgcagagcggcaagctcatcgaggcgatggactacggccgggaatccgggttggaccagttcgacctggacgtcggttcgtggtggacctgccacccgggcagggccgattacttcacccactggggcggggcgttcaagtacgccgcctcgctgcttgggctgccgatcggcgcctacccgcactcccgtcccccgcaggccgagctgcccgccgaggccaaggcccagatcgagaacgcctaccagcggctgggcctcctggcaacggcgttgcggtagaaggggttacacggaaacgggcccggtcatcgaccgggcccgcctcgcgtcactcactgttgctgttcggcccgttcgcgctgctcgtaggccttggccttgccccgggccttctcggcggcggcttccttcttgccggcgctgcgctgagcatccgccttgtcctgctgggccttgccctgctcgatcaggccgttgtggccgatgatgatgccgatgacctgcttggccctgcccagcacgtcgtcgacgatgccctgcaccagctcgaccgggccgctcttgacgtcaaccattgcgtctccttcccccatgatggtcggttctttccacggacgttcccgtcgtcccgccgggggcaaacatggcgccggcgtggccctcgccacaacgactgcgctccgcgcggccgggccgtcagcgagcggcggtacccggaggccggcgcggcgaaaatcgcagattagtcccggttcaagcgcgccataccgcagttgtggaatgcgctaccgataggtatacagtatgggtacaaacttgcctgctgggtcagcctgccgggtcagctgtgaggggacgccttgatgagtgccgccgaccatgtggtcaccgacgaggcggtgctgtaccagaccacggaaaccggcgttgcggtcgtgacgttcaaccggcccgggcggctcaacgcctggggacccgacatctcgagcggcttctacgcgtgcatcgaccgtgccgaggcggaccccgcggtccgggtgatcgtgttgacgggcgccggtcggggcttctgcgcgggcgccaacctgggcggcgcgggatccatcgacgcgaagctgggcgacggcgacaccgacgtcaccgcgttggtcggcgatcgccatccccacttcctgaccgcactgcgcaaaccgatcatcgccgcgatcaacggcgcctgcgtcggcatcgggctgacccacgccctgatgtgcgacgtgcggttcgcggccgccggcgccaagttcgccaccgcgttcacccgccggggactggtcgccgagtacggcatcacctggatcctgccgcggctggccggctggggcgcggcgatggacctgctgttgagcgggcgcaccttcttcgccgaggaggccgcaaaactcgggctggtcaacgagatcgtcgcacccgacgagctgatgacccgcgccctgacctacgccgacgacatcgcccgcaattgttcgccggcgtcgctggcggtgatcaagcggcaggcctacgacgacgcgctgcgcgacatcgtcgacgtcagcgcccgcgccgaaaccctcatgcacgagtcgctgcagcgccccgacgtcatcgagggcatcaccagcttcctggagaagcggccgccacggtttccacccctggccacctgacccgccggaaaggatcatcatgaccgccctgaactatcgcgtgatcgacgtcgacaaccactattacgagccgctggactcgttcacccgccacctcgacaagaagttcaaacgccgcggcgtccagatgctcagcgacggcaagcgcacctgggcggtgatcggcgaccgggtcaaccacttcatccccaaccccaccttcgacccgatcatcgtgccgggctgcctggacctgttgttccgcggcgagatccccgacggcgtcgacccggcgtcgctgatgaaggtcgagcggctggccgatcaccccgagtaccagaaccgcgacgcccggatcgcggtgatggacgagcaggacatcgagacggcgttcatgttgccgacgttcggttgcggggtcgaggaggcgctcaagcacgacatcgaggcgacgatggcgtccgtgcacgcgttcaacctgtggctcgacgaggactggggcttcgaccggcccgatcaccggatcatcgccgcgcccatcgtctcgctggccgatccgaccagggcggtcgaagaggtcgacttcgtgctggcccgcggcgccaagctggtgctggtgcgcccggcgccggtgcccggcctggtcaagccgcggtcgctgggtgatcgcagccacgacccggtgtgggcccggctggccgaagccggggtgccggtgggatttcacctgtccgacagcggctatctgcacatcgcggcggcctggggcggcaagtcgacgttcgagggcttcggcgcgaaggacccgctggatcaggtgctgctcgacgaccgggcgatccacgacacgatggcctcgatgatcgtgcacggcgtgttcacccggcaccccaaactcaaggcggtcagcatcgaaaacggttcgtacttcgtgcatcggctgatcaagcggctgaagaaggcggccaacacccagccccagtacttccccgaggacccggtggaacagctgcgcaacaacgtgtggatcgccccgtactacgaggacgacctgccggagctggcgcgggtcatcggcgtcgacaagatcctgttcggttccgactggccgcacggcgaaggccttgcatcgccggtgtcgttcaccgcggaactgaagggattcagcgagtccgacattcgaaagatcatgcgggacaacgccctcgatctgctcggcgtgcaagtcggctcggccgcctgagtatccgggaccgacgacgcccgtgagcgaatggaccataggggcggttctcgacgaaatcgccgacgtcatccccgaccgcacgatgacggtgtgcggcgaccgccgcagcacgttcgccgagtcggcggaccgcacccgccggttggcgaacttcctgtccggcaacggattgggcgtgcaccgggaacgcgcggtcctgcagaactgggagtgcgggcaggaccgggtcgccctggtcatgcacaacgatctgtacccggacatggtcgtcggctgcctcaaggcgcgcaccgtgccggtgaacgtcaactaccactacacgccgcgtgaggtcggtgagctcttcgactacctgagaccgcgggcggtcatctaccaccgcgggctggggccgaagttcgccgacgtcctcggccgcggcgacgtcgacctgctcatcgcggtcgacgacggcagcgaggccgcgcaactgccgggcgcggtgtcgctggatgatgctctggcccaaggcgataccggtcacccggcgccgggatcgccggacgatctgctgatgatctgcaccggcgggacgacgggccggcccaagggggtgctgtggcgccagtccgacatctacgtgtcgtcgatggtgggggcggatcacgcctgcgctcaggagatccgcgacaaggtcagcggcgccgccggggcgccgtggttcgccgtctcgccgctgatgcacgcggccggcatgtggacggcgttcgcggcgatcatggcggggaccaccgtggtgctctacgacaccggcaagaagctcgacccgcgatcggtctgggagaccgcccagcgtgagcgggtcgggatgatgaccatggtcggcgacgcctatgcggcaccgctggtcgccgaattgcagcgcggctcctatgatttgtcgtcgctgtacgccatcggcaccgggggagcggcaaccaaccccaaataccagcaggccctgctggagctgcttccccacatcactctcatcaacggttacgggtcgtcggagaccggcaacatgggattcggccacagccgaaccggcacccgaaccgacaccttcacactgcgcgagggtgggctggtgctcgccgaggactacagccgcttcctttcccccggcgagccgcagctgggctgggtcgcccgcgagggacgaatcccgttggggtacttcgacgatcccgacgccacccgcaagacctttccggtgatcgacggcaaacaagtggtgatctccggagaccgcgccgccctggaacccgacggaacactgcggttgttcgggcgggactcgctggtggtcaacaccggtggggagaaggtcttcgtcgaggaggtcgaggaggtgctgcgcgcccacccggccgtcgccgacgcgctggtggtcgggcggcccagcgggcgttggggcgaggaaatcgtcgcgctggtggaacttcgtgccggaaccggtgccgccgccgacgagttgcacgcgcactgcacgtcgcggctggcgcggttcaaggcgcccaaggaatttctgttcgtcgctgcggttcagcgcttgggcaacggtaaggcggattaccgttgggccaaacgtcacgctgtcaccgaagctagcgagaaggcgccgatgtcgacatgagagcaatcgattgtctggtcaacgtgcacttcggcgagaccgagaagcagccgacgtggatgctcaaggtgcgcgacgactacttcaagggaccggcgtcgatgttcgcgcccgtcgagttgtccgagctgatcgacgagatggacgcccagggggtgcgcaaagccatcctgatggacaacctggccaagccgtcggtgaccgcgcgcaagttcgtcgaggacaagcccgagcgtttcgccctggcgatgggtggggtgaagctgctgcggccgatcccgtccctgcgcgagctcggcgccgtcgtcgccgacctgcccgtcgcgtatgccgctgtgggaccgagcttttggggggatggccagtatccgcccagcgacgccgtctactatccgctctacaccaagtgcgccgagctcgagctgccgctgtgcgtcaacaccggcattcccgggcccccgatcccgggggaggtgcagaatccgatccacctcgaccgggtgtgcgtgcgcttcccggaactcaagctgtgcatgatccacggcgcggacccttggtgggacgtcgccatcaggctgttgctcaaatacgccaacctgcgcctgatgacgtcggcctggtcgccaaagcggttgccggagagcctgttgcactacatgcgcacccgcgggcaggacaaggtcatcttcgcgtccgactggccggtgctcaaaatgcatcgcgtcgtccccgaggcggccgagttggatctgcccgccgacgtgctggaaaactacctctacaacaacgcgcacgaattcttcttcggtggccacaaggaaggctgagtatggaccgctatgaactgcgcaggctcgactacagcctgaccgacgatcaccaggcgttgcaggccgcctaccgcgatttcttcacgacgcactgcccgatcgagacggtacgcgccgcagaggagaccggcttcgataagaacctgtgggagcggttgtgcgccatgggcgcaacgagcatggccgtcccggaatccgccggcggcgacggggcgacgctggtcgacctgacgttggtggccgaggagatcggcaggtcgctggcgccggtgccgtggatcgaccaggtctgcaccgcccggctgctggcccggctcggtgccgtggaacccgatgtcgttcacggcaagcggctcgcggggttcgatccgcagcacgacagcctgtcggggccccggctcatcccgaccgggtcgatcgccgacgcgatcatcgtgcgcgacggcgacgacgtcgtcgcgctgagcttcggcacccgccccgcgaaggtggacaacatcggccggctgcccatggcctgggtggatccggcggcggccgacacccgcaccgtgctggccggcggatcggacgcactcgcggaatatcaacgcgcacttgacgagtggcgcgtgctcaccgccgcggcgctggtcggcctggtggaggagaccatgacgatcgcggccgagttcgccaagacccgctacacgctgggggtgccgatctcgacgctgcagggcatctcgcacccgctggccaacatcgcgatcaccgtgcagggcggccgcaacctggcccggcgcgcggcctggttcctggacaacgagcccgacgagcggccggagctggcgccttcggcgttcgtgttcatggccgaggaagcagcgaaggcagccaccatggcggtgcatgtgcaaggcgggcttggtgtttcggcggaggcggcggcgacggcgtatctggtgcgggcccgcggctgggcgctggccggcggggatcccggggccagcgcgaagtacatcggcgagctcgtcgccgcacgggagagcggaaagggcgcataggtggacttctcacgtgtcacgctgtccgacgaggaccagcgattcctggacgaggctcgcgagttcctgcgcacccatgtgaccgacgaggtcaggcgccgggaccgggaaaccggcgacaacttcgacgagggcgtgcacctggcgttgggtgcggccggctatctggaacgcgaatggaagcccgaggccgagggcggtttcagccgggtgcaacgtcgcatctgggagctggagaagcggcgcgcccacgtgccctgggtgacctgggggaccaccgccatggtggcccgatcggtgaccaagttcgggtccgaggagttacagcgggaagtgctgcccggcgtgttcagcgggcacgtgcggctgtgcctgggctataccgaacccgagggcggatccgatgtggccacctgcaagaccagggcggtccgggacggcaacggctggatcatcaacggctccaagatgttcaccaccggggcgcacaactgccaatacgttttcctgatcaccaacaccgaccccgatgcgccgaagcacaagagcctgaccatgttcctggtgccgctggactcgccgggcatcgacatccagggcatccgcaccgtcgacggggaccgcaccaacatcgtctactacagcgacgtgcgggtcgacgacaagtatcggctgggcgacgtgaacgccggctggaccgttttgcgcgagccgctcaacgtcgaacacggggcggtggcggcggccccggacgggctgcaggacgtgtcgatcatgatgcaccaggccgggttcatggccgacgccctggacaaggtcgcggccaaggtcatgcagccagacccgcacgggcgcaggctcattgacgactcggcgatcgcgtatcggttgggccgcaacgccgcgcggatggaggcggcgctgagcgcgcccagcatctacggacgcgtcgccctcgcccagacgatgcgcgacatctccccggacctgatggacatcctgggcacggcgtccgcgctgccggtcggcaccgacggcgcggccgatgacggcgcctccgaatacgtcttccggttcgccccgctggtcggcatctacggcggcaccctcgaggtgttccgcaacatgatcgcgcagtacatgctcggcctgggcaagccggcctacgcgccggtggcccagcgcgccagctgacggcgcgcgccggcgggcctcctgcgcgcctcctgccgcgcctcctgcgcgccgaacgtgcactggccgcgaaattccgcgcactttttcgcgctgggtgcacgctcggcgacggtcaggtggtcaggatggtggccgccgcggtacccggggcaccgtagagctgagcgaacccgacgcgcggctcaccggccacctgccgatcgccggcttcgccacgcaattgccgcaccagctcgtggatttggcgcaggccggacgcgccgatcggttcgccgttggcgatcagcccgccgtcggtgttgatcggcatcgcgccggtgatctcggtgactccgtcggcgagcagcttctcctgctcgccgtcggcgcagaacccgcactcggccatgtggatgatctccgccccggcgtcggtgtcctgcagctggatcacgtcgacgtcttgcggtgccacaccggccttttcgaacgcggcccgcgccgcgtacacggtgggcgccacatcctcgtcgaccggggcgaaggtggtgttcacctcgtaggcgccgtagcggcgggtgcgcacctcgaccgcgcgcagatagacgggcttggcgctgtaccggtgcgcgatgtcggcccggcacatcaccaccgccgccgcgccctcgtcgggcgcgcagaacatgtactgggtgagcgggtagttcagcatcggcgagttgaggatctcatcctccggaatcggcttgcgccggaaggcattcgggttgcgggcgccgttgcggaagttcttggccgcgaccttggccagggtccgctgcgagatgccgtgctggtgcaggtagcggttggccttcatgccgaagaactgtgtggtgaggtactgcccattctcggcataccagcgcggcatccccaccagggccgggtcctcggtgaacgcaccccgcggatgcttgtccaggccgatggcgatgccgatgtcgtagtcaccgagccggattccgtcggcgcacgccttggcggcactggccgcggtcgcgcaggcattgaacacgttggtgaacggaatgcccgaaagccccaccatgccgacgatcgcgtccgggttggccaccgtccagctgcccccggtggcggcctggatgtccttccactcgacacccgcgtcggccaccgcgagctggatggcgtcgacggccatctccatcgcggtcttgccctcgaagcggccgaacgggtgcaggccgacgccgatgatggcgacgtcactcattggcgccgctcctcctcatcgcttcgctctgcatcgttgcggcgcgactcgcactcacgcaatggctcctgcattcttgagctcctcgatgcggtcccagtccatccccaactccatcagcaccagctcggtgtgctcactggcctggggtgccctcgtcgtcgcgagcggctcgtgattgaactgcaccgggccgcgcaccacgcggaaaggctttccgccgccggcgagttcgacctcggcgatcatgtcgttggcgatggcctgctcgtcgtcgatcaggtcgagcaggctctggaacggcgcccactggcccttcatcgtcttcaggtgctggcgccaatagtcaaagggcttggcggcgaacgcctttgcgatcagctcggcggccgcgtcggcgttctggatcagcggcagcacatcacagaaccggggatcgtcggccgcctcggggatgccgaggtgctcgaacgtgtcgcggatcagtccggtcgggctgatgatgcacaggttgatggtgccgccgtcggaggtctcatagttgcccatgaacggattcaccgacggcgtcccggcacccggcatcggggtgcgcatcacttcgccggtctccatgccctgcgtcacgctggcgcccgccgcccaccatgccgtgctcagcagcgacacgtcgagctcgacggcctcgccggtgcgttcacggtgcagcaacgccgccgagatcccgccggcgatgaacatgccgccgatggaatcgccgaatgcgggaatgccttgtcccagtgcgccgcccaactcctccggcgtcagcgcgtagccgatcccgctgcaagtccagaacgccgtcccgtcgtaaccgccgacgtcacgctcggcgcccttgtccccgtacgccgaaccgcgggcgtacacgatgttcgggttgaccgcccggatgtgctccacgtcgaacttgtgcttgcgacgctgcgcgggcatgtaattggtgaggaacacatcggaggtcttggccagttcgtagatcacctcctggccgcccggcgtggacacgtcgaccccgacgctgcgcttgccccggttggggtgctccatcagcgggtgacgctctggaacaacctggatgccacccatgttcacgaagccgcgctgggtgtcgccgcgcaccgggtgttcgaccttgatgacgtcggcaccccagtccgccaggatcgcgccggcggccgggacgaacgtgaactgcgcaacctcgaggacccgaaagccctgcattaccttcaccattcccgggaccctacttggcgtcgaaggtaaccggaagtgccgtcggagaccggaacggctgaccgtggatgtgcgggtcgccgtcgctgagcagggtgacgttggtcagccgattcagcaggcattccatcgcgacgcgcgtctccagccgcgctagatgcaggcccaggcaggtgtgctcgccggcggcgaaggagatgtgcggcacgtgtttacggaagatgtcgaattcctcggaacgctcccagcgccgctcgtcgcggttcgccgaaccgatgcacacgccgatcaccgaacgcgccggaatccgcacgccttgcagttcggtgtcttcggtggtgaaccgctgcacggtggtcagcggcgtctcgaagcgcaacccctcctcgatcgccggcgccagcagctcgcgatcggcctgcagcgcggcgaactggtccgggtgggtcagcagcagatacagcaggtttcccgacgaccggtaggtggtttccagcccggccggcaacagcagccgcaggaacgagtagatggcctcatcgctgagcttttccccgtcgatctccgcggtgaccaggtcgccgatgatgtcctcggtgggcttggacttgcgctgttcgatctgctcgaggaagtagtccttgagcgccgccgacgcctcgaaggcccgttcgtagtcgacgtggtagctgatcaactgcacggcgcgggtgtggaacatcggcaggtcttcgtcgggcagcccgagcagccgggcgatcacccgggtggggaactcgaaggtgaattgccttaccaggtcggcggttccggcatcgatgaagtcgtcgatcagcgcgttgcagatcgggcgcacaatggtgggctcccaccgggccagcgccttggacttgaacgccgccgacaccaggttgcggtggtcccggtgcttcttgccctccatcgccaggatcgtcggccccatgaacagcccgatggtcttgtcgtacggcttggaactgaacacccggccgtcgcggaacacggtgttgaccgcgtcgaaggacaccgcggagtattcctgcttgggcatcagggactccggcgtcttggagtagtccatcaccgtgccggcgaacacgccggcctcgcggcgtttgcgggcgaagaacgggtaggggtcacgcaggctgacggtctcgtctccggcggcggtgggaacgttggtcatcacctgatctccagcatcttgatctcagcacgatcgagcacttcttcgtaagatcatactgtaattattacagtagacaatatggcggggcgatgccccgatcgccgccggctgcggcgccgcaggtgtggtcagcggccggagtgggccgcgcgggagtcggtcaaccgcgcggcacgcgccagcaggcccgcataggccacaccgagcagccggggcagcgccgccatcgcccgtccgtcggccccgatcaggatccgggcccggttcttctcggcgccgcgcaggatgagccgggcggccctggcgggggtggtgagcgccgcccggtcgaagagctgggcggccaggtcgggatcctcggtgtccgaggtgcgcatgttggcgccgaagttggtacgcacgactccggggtgcacgcagtgcaccgtcaccggatggcgttcgatgatcatctcctggcgcagggcctccgtgaaaccgcgcaccgcgaacttcgacgtgctgtaggccccttggtaggggaccgcgatgagaccgaaggcgctggacaggttgaccaaccgcgacggccgccggtcggagccggcttcgatgagttgcggcagaaaggctttggtcccgttgaccacaccgccgacgttgatgcccatcagccagtcgaagtcctcccaggacatgtcggccacgctggcgaacaggtcgacgccggcgttgttgaacaccatcgaggcgggtccgtgcttgcggcgcacctcatcggcgaagcccagcaccgcatcccggtccgccacgtcgatgcgatacggcgtgacctgtccgggcccgcacgacgcctgggtttcggccaggccgttgtcgtagatgtcggacgccgcgacatgcgcgccgcccgcggtgagcgcctgcgtcagcgcccggccgatgcccgagccggcgcctgtgaccaccacgacccgcccttggtacttcatcggtgtgctcctagcctaaaagcactcggccccagcgggtttcatccgttcaccgcctgctcgcgcgcccaccggtaatcggccttgcccgacgggctgcgctcgatcaccggacggaacacgatcgccttgggaagcttgtagcgcgccagcgaattcgatgcgtgggcgatcaattctccggcgtcgacggcggcgccgtcggacagcgcgaccacggcgacgacttcctggccccaccgttcactcggccgtccggccaccaccacgtcggccaccgcgggatgcgacgcgatggccgtctcgacctcctcgacgaaaatcttctcgccgccggaattgatgcacacggagtcgcggcccagcagctcgatatggccgtcggcgtggtggcgtgcccggtcgcccggcaccgcgtagcgcaccccgtcgatgaccggaaaggtcttggcggtcttggcggcatcgcccttgtacccgagcgggacatagccgcgctgggccaaccagcccatcccctcgtgcccgggcggcaggatcgccgacaggtcctcggccgccacgaaggtgtccgggccggcgttgaaggtgccggtcgccaccgccccgggcgtcgacatgtggtgcatctgcgccccggtctccgacgacccgacgccgtcgacgaccaccgcgttcggcagtacttcgatcaagcgctgcttgacgaacggggtcagcaacgcgccgccgttggccaccacggccagcgacgacacgtcggcgatccccttctcgatggccgcgaccaacgggcgggccatcgcgtcacccaccaccgtcaccaccatgaccttttcccgctcgatggtgcgcaccacgtcctcggcgtccaaatggtcgacgacagtggggaagacgaccgtctggccggtcgtgatcgccgtcatcacgctccactgggccgcgccgtggatcagcggcggcaggatcatcagcttggtccccgggccagacgcggcgcgctgcacgatctcgtcgatcgacgacgagggctcgccggtcatcaggttgcgccccccgaaggacgtcatgaagatgtcgtgctgacgccacaacacgcccttgggcattcccgtggtgccgccggtgtacagcacgtacaggtcgtccggacagtgccgcaccggtggtggctccgcggacaccgacgccagcgcgtcctcgtaatccactgcgccgtcgagtaattcgttgcccgactcgtcggcgatctggataagcacccgtagccgcggcagctcgggcaggatctcggccacccggggcgcgaacgccgcgtggtagatcagcgcggtcgcctcggagtccgcgagcaggtagtgcagttcgcttttgacgtagcggaagttgacgttgaacggggcgacgcgcgcagcgaaggcgcccagcagcgcttcgacgaattcgcttccgttgtacgcgtagaggccgagcaggtcctggcccacctcgtggccggccagcgcctcgcgctcggtgtggcatcccagacctcgggagtgcagatacgcggcgagccggttcgaccgttcgatcacctgccggtaggtgtagcgacggtcgccctggatgatcagctcgcggtcggggatcgcggccgcgacggccttcgcgaccgccggtaccgtgaatgctgttgtggtgtcggacattttcgcctctcacggctggtggggtagcaggcggaccatcaggccggtggcctcactgagcagcgtgccgtcggccgccgtcatgctagcggagatgaagatcttgcggccgtcgacgtcggtgatgcggccgtgcgccgtcagcggcgcgtcgatcggggtgacgttgcggtaatccacgtgtaggaaggcggtgcgcgtgggtggacagttcgcgccggacaccaccatgccgaacagccagtcgtagtagagcgggatcatgccgccgtgtacggcgttgttgccgcccacgtgcgatcgggtgaaatgcccctgcatggtgacgccgtgcgcgccggagtcggcgacggtccacggcggcagcagcgggtggccgaggccgggcagttcgatgacccgcccggccggcgacacgccttcgggaacctggtggccgtccagcaccgcgcaggcgtcctcgacgtgctgggcggcgacggtccacagcggatccgccgggttggtggcgacggtcaggtcctgcagccggcgcagcgcggcgatcagccggcccagacccggcggcgccgactcggcgggcttgatctcggggaatccgccggcagacccgtccagcgtgccgggtgcggtgtcggtcatggccggctccaggcgcgcagcagctcgtcggtggtggtgatggtggccagcagcgacaacgtgttcgcgatgaccgcctcgccgtactcggcggggacgccggcgacggcgtcgcgcgggacgacgacgcggtaggcggcgttgaccgcatccatgacgacgttgggaatcgcgatgttcaacgagacgccgaccaccaccagggtggacacgcccaggttgcgcaacaccgcgtcgaggtcggtaccgcccatcgggcccacgccatgccaccggctcagcaccaaatcgcttggctcggggcctaattcgggcaacagcgtggcccccggggtgccgggggagatgtccacccggccttgcccggagcggcgacccaacgcgaagatcttggcgttgtgattggagcccagtccgtccgggcgccgctgcaccaggcagtgcacgattcgcacaccggcggcgcgggccggcggcaacagccgcacgatgttcggcagcgcgacccggcgggcttccgcggccagcgcgcccaggccggcgtcgggaccgacgaccgcaccctggacttcttgcgtgatgacggcggtgtgcgccggcgccaccagctctgccaggtccgtcatgccggtgacgacgttccggccggcggcagctcatagaattgggtggcccatttgcgcagtgccatatagcctttggcgtcgaccttggacaacggcgggtgctcgacgtatttctggtagcgccagatctgcagatcgtcgaagacggtggacaggaactgcttttcgatgacctcgcgcagcttgccctcgggcacgtcggcggtgtcgccggggacgcggggccaccagatcgaatagaacaggtccgagcactcgtcgtcgaccggtgtgcaggtgaagatcagccgatggttctgcgcgccttcgaagacgctgatcgccccgcccaggccgaacaggtggctgtggaagcgcagcgcgagggccgcggggtcgtcgctgttggcatcgggccagccggcgacgaactgccattcctgctcgacgatcttccagtccagcacccgcggcgtcaccgtggcgtggtgcacgtactcgaaatgggcgctgtcgggcgcgttttcggccacgatctgcggatgcaccggctcacgctcggcgcgccgggaaaactcggggtaggcccggtagtaggccgccgggtcggtctcgaattgcgggaacttaccgaagatgtccggcatctcccactgcggctccttgccgtgcggctggtgccagacgaacacgcagtcgtactgctcgcgcaccgggtacaccttcagccgcaacccgcggttgggccgatcgggttggtaggggatgtagcggttggtgccgtcgggcccccagcgccagccgtggaaggggcactgcacgcagtcgccgaccaccgtgccaccgtgcccgagatgggcgcccaggtgtttgcagtgcgcctccaagatgtgcagttcgccggactcgtcgcggtaggccaccaggtcctcgccgaaatagtgcaacgggcgcacctctccgatggggaactccggtgaccagccgaccatgaaccagccggtgaccttccaggtgaaggggactttcacgccagcgcctccgatacgttgatactaagtccattacagtatagatttcagcagtccggccgtcgcgcggcaaggagtgacatgacgacagcggctgaccagccagggcggtgaggatgaccgaagccgacaccccgttcgacgtactcgtcatcggcgcgggattctccgggctgtacatgctgcaccggctgcgccaactcggcatccccgcccgggtgctggagatggccgaaaacgtccgtggcacctggcttttcaaccgatatccgggcgcacggtgcgacatcgagagcatcgaatactcctacagcttctccgaggagatccagcaggagtgggtgtggacggagtcgatgccggcgcagcccgagatcttggcctacctcaactacgtcgccgaccggctcgacctgcgccgcgacatccaattcggcgccgaggtcgtcgcgatgaccttcgacgaagacgccgcgatgtggtcggtgcgcacccggtccggcgacaccttccgcgttccgttcgtggtcgccgcctccggcatcctgtcggtgccgctgcagcccgacatccccgggatgaacaccttcgccgggacgtcgctgttcaccagccgctggccggccgcgggcgtcgacctgaccggcaagcgcgtcggcgtcatcggcaccggctcgaccggtgtccagctcatccccgtggttgcccgagaagcgttgcacctctcggtgtttcagcgttcacccgcatacaccctgccctggcgggtgcaccgattccagcccggcgagctggacgagatgaaggcgcgctacggcgaaatccgcgccgctcaacgcgcccacccgatcggcgcggcccggctgagcgccttttccgtcctgctggaaatgctcgggcggccgccgctgaaatcggccacccccgaagaacgactgcgcgccatcgaggagcacggcgtcctgggggcgttgaactggggtgacgtcttcttcgacatcgaagccaaccggatggccgccgaactatacggcgaggcggtcgcgcggatcgtcaaagaccccgagaccgcggcgtcgttggtgccggtgcatcccttcgcctgcaagcggccgatcatcgaccagggctactacgagaccttcaatcgcgacaacgtcaccctcgtcgacctgcgcaagtcgccgatccgggaggtcaccccggccggcattcgcaccgaggaccgattgcacgagctcgacgtcatcgtctacgccaccggcttcgacgccatgaccggtgcgctcagccggatcgacatccggggccgcggcggcatcgggctggccgagttctgggccacccaggggccgctgtcgtatttgggcctggcggtcgccggctttccgaacctgttcaccgtccagggcccgggcagccccagtgccgccaccaacttcgtcgccgccctcgaacagcacgtggaatggatcggcgactgcatcggatacctgcgcgccaaccacattcgcaccatcgaggcgctgagcaccgcccagcaggagtggatcgagcacaccaccgcgctcgtcgcgcccacggttctggtccacccgtcgtgcaactcctggtacaacggtggcaacgtgcccggcaagaaacggatgtacatgggctataccggcgggatccccgaataccggcgccggtgcgacgaaatcgcggccggcggctacaccggtttcaagctggcttagttgaaggtgagcggatggcgaaggcattgagcgggctcagcctggccagagacgccgcccgggaactggccatgctggtgccgcggactgtggcgggcctgcaggagtcgaccggttgggctccgctgtcgccccgcggcgcacgccagttcggcgaggtcatgctggacgagcttgtgctgagcgccttttcactgctgggtggcagcccggcggcgctgcggccggttgacgcctgcgccgcggccgccgaggaactcgccgcgctgggcatcgacggcgcgcatgccgcgccgaacccgttgcggccgacgtcgattcggcggcgcagcatcgccggtctcgactacgaacggatggccttcgagcacgaccccgcgctgccgacgacgctggtggccgacggcttgggcggcccggcccgggcggtggtgcacctgcgccggcaccgtgacgggcccagaccctggctggtctgggtgcacggcgccggccagggcggcaccgaagacctgctgctgtccggcatcgaccgaatacatcacaagctggggttcaacatcgcgatgccggtacagcccggacacgggtgccggcgccggcagtggccggtctaccccgacatggatccgctgggcaacgtcgcgggcatgatgcgcgcggtgtcggaggtgcgcgccgtggtgcgctgggcccggtcgcaggccagcacccttgtggtggcgggcatttcgatgggcagcccggtggccgcgctggtctcccacctggagaggcgggtcgacgccgtcgcgctgtacacgcccatcctgggactcaacgcgatgatcgcccggcacctgcagcgctgggggccggcccgggacggattccgcgaactgctggaatccccggtggtcacccagctcacctcggtgatcgacccgctggcggtgaccccggcgccgccgccggagcgccggctcatcgtgggggcctggcacgaccggatggcgatgcgcgagcccgcgaacgccttacaggaccgctgggccggccagttgtactggtacgacggcagccacgtcgggcacatcttctcccggcgggtacagcgcatcaccgaccggttcctgcgcgacgcggtgcttgcctgatgcggcccacctggaccgcgcgcaccgtggtcgagctgtacaacctggtggtgtggaacgaacgcaacatcgaactggcccgggagttgttgggcgacacggtcatccggcatgaggtcggtgcggcgcacacgctgacacacgccgaggcggtacagcgggtggtggacatgtgggagatggccgactcgttgcacttcgacctcaacgtcgtcgtcgagggcgacgacggcgagcacgtggcgatcgtctacgactcgacgatcaggaccaaggacggcgcggaaaccaacatcgccggcatcgaggttttccgggtcgtcgatggcaagatcaccgaggtttggaactgcggctaccagcaaggggtttggaattgagcgaccgggtgcttgacgagttgggcttctatctgctggccggggcaggaggtgagggcccggcgaccctgatggacgaggcccgccgcggagaggaactcggcttcggcaccgccttcatctccgagcggtggaacgtcaaagaggcgtcgtctctggtcggggcggcgtgcgcggtcacccaccggatgcagatcgccaccgccgcaaccaatcacaacacccgtcatccgctgatcaccgggtcgtgggcgaccacgatgcatcgcctgtccggcggccggttcaccctcggcgtaggacgggggatcgccgcgatctatggggcgttcggcataccggcggtgacgaccgcgcagatggaggactgggccggggtgatgcgccgcctgtggcacggcgagctgatcttcaaccacgacggaccgatgggtaagtaccccatcctgcttctcgatccggacttcaacgaggacatccggctggccctggtggcgttcgggcccaacacgctcgcgctcggcgggcgggtgttcgacgacgtcatactgcacacctacttcaccccggagaccttgcagcgcagcgtcaagaccgtcaagtcggccgcggagaaggcgggccgcgaccccgacagcgtgcgggtgtggtcgtgcttcgccaccgtcggcgaccatctgcccgaacagctgcggctgaagaagacggtcgcccggctggccacctacctgcagggctacggagacctgctggtgcgcaccaacgactgggatcccgctgtgctgcaacggttccgcgacgacccggtggtgacgtcgatcgccggcgggatcgaccacaaggccaccccggagcagatcgagcacatcgcgacgctgatccccgacgaatggctggaaccctcggccaccgggtctgcgcagcagtgtgtggcccgcatccgcaaggaattcgactacggcgccgacgcggtcatcctgcacggcgccacacccgacgagctcgagccgatcgtcgccgcataccgagccggctgaccgcgaaagtgcaactagcgacgcgtttcccgagaggtgccgtcggtagttgcactctcgcggcgtaccggttcagggcatgatgacggtccggctcaccggttcggcggcggcctgccggctggataggccgcgccgcaacgacgccagcaacgcgtcccgcgtctcacgcgggtcgatgagttcatcgaaccccatgtgctcggccgaccggtaggaggcctgcagctcggcgttgcgcagcttggtggagaggtcctcaccggcgtgcgaggcgcggctcagcgccgccgcgctcatcgcgcccatggtcgcacccgggtaggcgaacgtcgcgacctgatggtcgaaccccaacagcgacatgaccatcgacccgaacccgtacgccttgcgcagcgtgacgtgcagcttcaacgtggtcgccgcggtctgggcggcgaacatccgcgcgccggcgcgcagcacaccgctgcgttcggaccggctgccgggcagcatgcccgggttatcggcgaggaagacgatcggcaggtggaacgagtcggccaccatgatgaagtgtgccgccttgtcggcggcgtcggcgtcgatggagccggccagcacctgaggctggttggccaccaccgcgacggggtggccgccgaggtgggcgagcgcgcagatgatcgccttgccgaactggggttgcacctcgaaccagtcggggctgtcgaacaccacgtcgagcacggcgcgcatgtcgtagacgcggcggttgtcccgggagacgatgtccagcagctccggcgtcggccgcggcatggcggcgtcgccgggcggcagcgacggcgggtacgaccaggcgctgggcgggaagtaggacaggtagcggcggacgtcgtcgagcgccgcttcgtcgttttcggcgacgttgtggatcacgccgctgggcagcgcgacatccggcccgcccaggtcctctttcgaaatgtcttctccggtggactctttgacgacgggaggcccggcggtgaagatcgccccctgcctgctcatgatccggaagtcgcagaccggggccaccagcgcgccgtgtccggccgacgggccgagcacggcggcgacggtcggaacccgacccgagcactgcgcctgggccagcaggtcggtcggggtgcggccgtaatgcccgccggtggggcgaaagcccgcgccctcgagcagcatgaccaacggaatcttgtcccgcaacgccagttcggcgatgcggtagcgcttcgagttgccgccgggcccgatgctgcccgccagggtggtgaaatcctcggcgcccagcatcaccggcgtgccgttgatctcgccggagccgaccaccaggccgtcggcggcgatctcgccaccgaccagggtgccgagttcgcggaacgtgcccgggtcgagcaggtattcgatacgggcgcgggcgtcgagtttgcccttgttgcggtgtttgtccagccgctccgggccgcccatgtcgaacgcgtgctgacggcgccgctggagatcggcgagcgtttcttcccagtcctgggctttcggcatgcctatgtcctacctcatggaggattcgtcgcgcgaccagtcgggggcgggccgcagatctgcagggtcacatactggattgcttactgtaaagttacccgcatgcctgaccccggccgtctcgaggtcggcggcaccgagcatcccggatcgaggagttgcaccagtgagcacaaccacgatggacgaggccgccaagttgctggccgatccgatggcctacaccgacgagcagcgactgcatgcggcactgacccacctgcgcgccaacgccccggtgtcctgggtggaggtgccgaactacaagccgttctgggcgatcaccaaacacgccgacgtcatggacatcgagcgggagaacatgctgttcaccaactggccgcgcccggtgctgaccaccgccgagggcgacgagatgcaggccgccgcgggggtgcgcaccctgatccacatggacgacccccagcaccgggtggtgcgcgccatcggctcggactggttccggccaaaggcgatgcgggcgttgaaggttcgcgtcgacgagctggccaagatctacgtcgacaagatgctggcggccggaccggaatgcgacttcgtccaggaggtcgcggtcaattaccccctctacgtgatcatgtcgctgctgggcctgccggaggccgacttcccccggatgctcaaactgacccaggagctgttcggcagcgacgactcggaattcaagcgcggcagctccaacgaggatcagctgccggcgctgctggacatgttcggctacttcaacggcgtcaccgccgcgcgccgcgagcatccgaccgaggatctcgcgtcggcgatcgccaacgcccgggttgacggcgaaccgctctcggacatcgacaccgtctcctactacctgatcgtcgccaccgccggccacgacaccaccagcgccaccatctccggtggcctgcaggcactcatcgagaaccccgaccagctgcagcggctgcgcgacaacctcgacctgatgccgctggccaccgaggagatgatccgctgggtcaccccggtcaaggagttcatgcgcaccgctgccaaagacaccgtggtgcgtggagtgcccatcgccgcgggcgaatccgtgctgctgtcctacgtctcggcgaaccgcgacgaggacgtgttcgacgagccgttccgcttcgacgtcgggcgcgaccccaacaagcatctggccttcggctacggcgtgcacttctgcatgggtgcggcgctggcccgcatggaggtcaacagtttcttcaccgagctgctgccccggctgaaatccattgagctgaccggtgatccggagctggtggccaccaccttcgtcggcggcctcaagcacctgccggtgcggtattcgctggcgtgagtcggggtcaggccgccacctctgcgtgatcgctacactcccggtggaggtctggcaatgacgcgcaggacgattgtcatcacgggcgccagcgacggcatcggcgcggccgcggctcgtcgcctcagccgcgccggcgaccggatcgtcgtggtcggccgctcccaaaccaagaccgccgcggtggccgccgaattgggcgccgatcacttcgtcgtcgattacgccgacctgtcccaggtgcgggcgctggcggacaagatgcgtgcgcaatacccgcgcatcgacgtgttgctcaacaacgcgggcggggtggccagcaggatcgagctgacggccgacggctacgaacgcacctatcaggtcaactacctggcgccgttcctgttgaccacccagttgctggatgtgctgctggagtcccgggccacggtcgtcaacacgaccagctcctcgcacaagctgatcctccgtgccaccgtcgacgacctggagaacaccgccaaccgcaggcccgccgtcgcttacgcgtactcgaagctggcaatcgtgttgttcaccaaggaattacaccggcgctaccacgcgcgcggcctttccgttgcggccgtgcatcccggcaacgtcaactccaacatcggcatcgcctcgggttcgcgatttctggtgttcatgcagcggtacaccccggcggcgctgttcatctcgagcccggaccagggcgccgaccccttggtgcggctggcctcgagcccgcccgattcggagtggacgtccggcgcgtactacgccaagcgcaagatcggcaaaaccactcgcctggcggacgatccgcgattggccgccgaactgtgggagcgcaccgcggccaggctcggctgacgagctcccggggtcggcggaggaccgcccgggtgatcttcgatactcgctggtatctatcagatactggccggtatgctgctgggcatgtcgcccgtcaaaccgcttcgcagccgccccacccgcggcgaggttcgcgaccggatcctggatgcggcggcgaaggtgttcgcggccgagggcttcgccggggccaccatcgacgcgatcggtcaggccgcggggttcaccaagggagcggtctattccaacttcgagtccaaggacgagctattcctggccctgctcgaccgcgagttcgagctgcgcgggcagcagatcgcgatagcgctggaccgcagcgccggcgacaccaccgcggccgcgcgcgaggtgagccggtcggtgctcgactcggtccgcgaccattccgactactacgtgctgctcgtcgagtactggctgcgcgcccagcgcgatccgcagcttcgggaatgcctgatcgagcgtcgccgcgccgcggccgaccaggccctgcacatcgtcgagtcgaccgacaccgtgccgggcgaccggcggctgaccgacatcgcccagctcgtcgtcaccctcaacctgggcgtggcgatggaagaggtgctgcgcccgggaaccatcaaccccgacctgctcgcccagctgatcaccgcgctgctggaatcgataccggtctgacggtgatgagggaaagccacaccatggatgccaacaacgaaccggacgacgtcgcaccggtgatcaccgccgccggattgggggtcgacggcgagcacgggccgctgttctcgggggtcgacctggccctgacgccgggctttcacgcgattcagatgcccggcggaccggggcagaccacactgctgctgacgctcgcgggacggttcaagcccagccacggcacgctcaccgtcctcggcgcaacaaccccgcgcgcgatccgccggcactgctccatcgcggcgttcgaaggcatcgacgatctcgaggattcggtgaccgtggggaccgtgctcgccgagcaacgccggtggctggcgccctggtactcgtcggtgccgctgcaatcgggcccggccgagctcaccgaggtcttcggcgacacggccccgccatccgacaacacctacgtcgtcgaactgtcggacctcgaactgttcctgctgcggatcacgctggcgttgctgtcgaaccgtccgattctggtggtcggcgacctcgaacaggttcgtgacaactcccgacgagcgatcgcggccgagcggctcggcgcgatcgcgaggcggcgcaccgtcgtcgtcggggtgaccaacccgctcggcgccgacgcgcccgaccacgaactccacgatcaccgcatcccgaccggggaggactgaaagatgctggctggactcgcctttggctcagagatcaaacgcttccggcgcagccgattgacgcgcgcggccatcgtcgtgctgatgctgctccccctggtgtacggggcgctgtacctgtgggccttctgggatcccttcggccacaccaacaagatgccggtggcgctggtcaactccgaccggggcgccgtcgtgtccggccagcagttcaacgccggtgcggagatcgccaagagtctgaccgccgacggcagcctggactggcacgtcgtggacttaccggaggcacgcaacggagtcgaccacggcaagtactacttcatggtcgagctgccgccggacttcagcgcggcgatcgcgtcgccggtgaccgggcaacccaagaaggccaacctgatcgccgtctacaacgacgccaacaactacatctcgacgagcatcggtcgtaccgccatcgagcaggtactcaacgccgtctccagccggatctcgggacaggccgtcaatcagatgctgtcggtggtggtttcgtccggatcgggtatcaagcaggccgcagacggggcggcccgactcgacgacggcgccggtcagctggcagccggcctggacagcgcgcggaccggctcggcgacgctcgccgccggcgccacgcaactgtccgacggaatcaaccaggccaccgacccgctgctcgcggtgaccaaggcggtatcgcagatcggcggcagcacagagcaattgcagcagggcgccaccgcgctcgcacaggccaacgatcagctcggcgccatcgccgcggcgcaggacgccgccgcgagctcgctgacgtcggtgatcgaccagctctccgcgcgagcggatccgctggcgaacaacctgcgcggcatccaggatcaactccggggtcaccagttcaccccccagatccgccagcagctcaccgatgcgcagaacgcggcaatcgccatgacctcggggttgcggaccccgggcagtccgctcgcgtcggcgctcgatcagctcggcggcaagggccaggagctgaccaacaagctcacccagctgcgcgacggggcgcagcaagtcgccaccggtaacgccgaattggccggcggcatcgccaagctcgacgacggcgccggccaactcaaagcgggatcggccgagctggcgacgaaactcgccgagggcgccaggcaggtgccgaactggaccacccagcaaaaggaagcggtcgccgacaccatcggcggcccggtgcaactcgaggcttcccatgagaacgccgcgcccaacttcggcaccggtatggccccgttcttcctcaccctcgccctgttcttcggcgcattggtgctgtggatggtgttgcggcccttgcaatatcgtgcgatcgccgcggaggtgatcgcgatccgcgtggtgctcgccagctacctgcccgccgctgcgatcgcgctgttccaggccgtcgttctctactgtgtggtccggttcgccctcggcatgcacgccgtccacccggtggcgatgctggggttcatggtgctgatttccggcgcgttcgtggccgcgacgcaggccatcaacgctcttgtcggtccggcggtgggccgggtgctgatcatggccctgctcatgctgcagctcgtcagcgcgggcgggatgtatcccgtggaaaccacgtcgcggccgttccaggtcctgcaccgcttcgacccgatgacgtacggcgtcaacggactccggcagctcatcctcggcggcatcgacgcccgactgtggcaggcgatcatcgtgctggccgcgataacggccgtcgcactggcgatctcgtgtctatcggcgcgcagagaccggctgtggaacctcagcaggctgttccccgcgatcaagatgtaggccgcgcgctcaggcgatcccgaaatcgatgatgccccgcacgattttgccgttgagcaggtcgtcgtaggcgtcgttgactcgtccaggcgatagcgcttggtgatcatctcgtccagctgcagctgaccggactgatagagcctggccagccgggagatgtcggccctggggttgcacgagccgaagatggtgcccgccagcgtcttgttcatcaggatgaagtcctgcagctcgatgttgaccgaccgggtcaactgcgacgtcatgccggtgagcacacaggttccgcccttgcgggtcagcttcagcgcgtcgcgcacgtcatcggctgtgatcaacgacggcgagaccaccaccgcgtcggccatcaccccataagtcaagtcccgcaccaggtccagggcctcggcgatggtcgccacgctgtgcgtggcgccgaaccgcagcgccgacttctgcttgaactccactgggtcgaccgcgacgatctgcgcggcaccgctgatccgggcgccctggatggctccggtgccgatgccgccggcgccgatcaccaccacggcgtccccgccgcgcaccccggcccggttggcggccgagccgtagccggtcgggatggcgcaggacagcagcgcgctcggcgccagcggcaactgctgctcgatcttcaccagcgaattcgtcgacaccacagtgtgttcggcgaaggcgccgatcttcgcgatgtggccgagattgccgccgccggccgtgtggtggcggaaggtgccgtcggtgggcatcccagggatcatggtgccgatgcccacgtcgcagaggtactccattccgcttgcgcaccaacggcattggccgcacacggcgacgaacgacatcaccacgtgatcgcccggcgcgaaatcggtgacgccctcacccacctcgcgcacgatgcccgaaccctcgtggccgccgatggtggggaacatggtgggcagccccagcgatcgcatcacctcgttgggcgccgacatgtcgcccttgaggatgtggtcgtcggagtggcacaaaccggcggcggccatctgcaccaggacctccccggcgcgcggcgggtccagctcgaactcctcgaccgaccaagggccgccgacgtcatgcaggatcgctgcccggcttttcatgcggcgggcgcgaacgtgacgggaagcttgttgggggagcggaaggtgagcccgacgatcttggactcctcgccggttccgtcgtcgggcacgaacgccaaatcccgcacccggtcgaacaggctgttcaacatcacccgggtttccagtcgcgccaaatgcatgcccaggcacatgtggatgcccccggcgaaggcgatgtgggcctggcggggccggcggatgtcgaaggcgttgggatcggtccagcgggtctcgtcgcgattggccgagcccatgcacatgtcgatctgggcgttggccgggatggtcttgccgccgatttcgacctcctcggtggtggtccgagtgaccatggtcagcggtgtctcgaaccgcaggccctcctcgatcgccatcggtatcaacgaccggtcccgatagaccatcgccaactgctcggggtgggtcagcaacaggtacagcaggttgcccgaggagcggtaggtggtctccagcccgccgggcagcagcaaccgcaggaacgcgatgatggcctcatcggtgagcttttcgccgtcgatctccgcggccaccaggtcgccgatgatgtcgtcggtgggtttgcgccggcgctgctcgacctgtttgaggaagtagtcgtaaagctcggtcgcggcgttcaggccggcctcgatgtcggtggggatggagatcaggtccagcgacagccggcggaacaggtcgagatcctcggcgggcagaccgagcagcgtcgagatgatccgcgtggggaactcgaatgtcaccgccttcaccaaatcggcgtggccgtcgttcttgatctcgtcgaccagttgctcgcagaccggcccgatgaccgacggctcccagcgctccagcgcggtggcgcgaaaggccttggccaccaagttgcggtggtcgtggtgttcccggccgcccatcgcgaggatggtgtggcccatcaccaggccgatggtctcgtcgtacttgtgcgagctgaagatccggtcgtcgcggaaggcctgcgacacgctctcgtagtcgaacagcacccactcgtcctcggggcgcagttcctcgggcagctggctggcgtcggccagcgagccgtgccagaccgggtcggtgcgccgcatgtgttcgaagaacgggtacgggctggtctcgccggtgaagtcgagcgtcggtacgacgggttgaccggtcgggccagtgctcagcggcatagcgctccttacgcgaaaacggaccggtggcgcgggccgcgcgcgggtccacggcgggtcggtaccgagcggaatatcgctatcatagtataaatagcaacgaagcccaatggccgcggcctgttcgccgcccgcggcctccggtcggcgaaccgcgatccccggcccaccgggagccgcccctcctttccgcccgcccaaaagcgcaggtctactttgaaggtggtgtccggcaccaccgtccgccgggaccgtcgacgagcccgccgatcagccgacgaaaacgagtaggtatgacacagacgaacctggcccggccgcaaggccttacccgcatcgacccggcgctgcgggacaccgccgcccagttgggggtggtggagttccgcgccgaaaccctggccgccgagcgggaacacgccaaccggttggccgcccagcgcgccgcatccgccgacacccgcggcgtggcgatcgattcggtgtcgatcgccgggccggacggtcagccgctggagcttcgcttgtatcgcggccacaccgaatccgcggcgccgctgctggtgtacgcccacggcggcgcgttcgtcaccggcaacctcgccaccgaccacgcgcactgcgtggagttggcccgtgacggcgggtgtctggtggtgtcggtcgactaccggctggcgcccgaaaatccctgtcccgcggcgctggacgacgtcgaagccgccttccggtacgtcgtcgacaacagcgcggcgctgaacgccgacgccaaccgcatcgccgtgatgggccgggacgccggcgcggccctggtggcgggcctgacccagcgcatgttcgaccaggaggggccgacgatcctgatgcagatcctgcaccagccgatgctggattccgacgccacgccgtcgcgtcgcgaattccagcgcacgccgggtctgaacggtccggccgtgagccgggcctggaaccactacctcggtcacgccagcgccagcggtcagcacgtccccgcccaccgggccaacctcgagggcctgccgcccacgttcatcagctgctcggagatcgatccgtgccgcgacgaggccatcgactatgccaatcggctgctgcacgcctacgtgcacaccgaattgcatgtgatcgcagcaaccttcaacggtttcgactcgatggtcccggattggattgttgcccaagagaaccgggcgctgcacgcgcaggcgttacgccgcgtcttcgccatgtaggacgggccgggtgtctgccggcggccgccgcagccggagcggcgacgcgggccgccgcttaccgactgaactccggtatctcttaccgtagtgcgcgttgctaacatcggaatcggcagccaaccgaggaccgatcgggcggatgatcaaacactcaaaccgattccgttgcacccgcagcgatcgaatgtcacgaaggatcccctcggcaccatgagcaccgtcgactccccggaaaagatcctcttcacctcgaccacccaagctttcctggaaaaggaggcgccgctgcgtcgggtgcgggagctgcatgccgccggcaccgcgttcgaccccggctggtggcggcgcgccgccgagctcggctggacgggcctgctggttcccgaagagttgggcggcggcagcgtctcggagagcggcctggccgatctggcgacggtcgccgaacaactcggcaagaccgtcgcgcccggcccgctgtacccggtcagcatcgtgctgtcggcgctggccgaatgttccggcgccgaaacgcacggcgacgtcatcgaggcgctgatctccggtgaaaccgtcgcgtcctgggcggtgtatgaaccgggtcagggctgggcgccgctgaatccgtcggtgacggccaccgaaaccgactccggttatcgcatcgacggcgtcaaggaccgcgtggaggcgggcgcccagagcgcgctgctgctggtggtcgcgcgctgcggcgccgacgggcagatccgccagttcctggtcccgacggacacgccgggggtgcggatcgagccccagcagtcggtggacctggtcaagcagtacgcccgggtgcacttcgacggtgtcgtcgtgccgcggtccgccgcggtcggcaccgccgccgagaccgccaccctgatcgagcgacaaagccagctcggccaggtgctgcaatgcgccgaggtggtcggggtggtgcagacggtgttcgacttcaccacccaatgggcgctggaccggcacaccttcggtcgtccgctggcgtcgtatcaggccctcaaacacaagttcgccgacatgaagctatggctggaggcatgccgggccaccacctgggcggcggtcgccgaggtggccgcccgctcgccgcaggcggggctgtcggccagcatcgccaagtcctatgtgggcgagatggccgggcagatcgtgcaggcctgcgtgcagatgcacggcggtatcggcgtcacctgggaacacgacctgcacctgtacctgcgccgggttacgttgtaccgcggcatgttcggcacgccggaggaacacaacctgcgcgtctaccagttcgagaaggcggggcgtgcggcgaaatgacgaccgaatccgtcgcgcaattcgcggcccgggcgcgagcctggttggccgacaacatgcccgccatcgaccgcgagtccccaccaccggccccgcgcgacgacgagcgggcctggcgcagggcccgcgaactgcagaagcggctgtacgacggcggtttcgcgggcatatgctttccccgcgagtacggcggcctgggactggactacgaataccagaaggcattcgacgccgaaagcctcgactatgaaatgccgttgatcctcaacaccccgaccttcaccatctgctgcgcgacgctgctcgacaccgccagcgagcagcagaaggaacagcacatcgccgcggcactgcgcggcgaggaaatcctggtgcagctgttgagcgaacccagcggcaggtcggatctggccggtgtgctcacccgggccgagcggcgcggcgaccggtggatcatcaacggcgccaagacctggagcacgagcgcgttcgccgccgactacggcctgtgcctggcccgcaccaactgggacgtgcccaagcacgaaggcctgaccatgttcctggtgcccatcaaccatcccggaatcacgttgcggcgcatcaccatgctcagcggctccaccgagttctgcgaggagttcctggacggtgtcgacgtgggggatgacgccgtcgtcggggaggtcaacggcggctgggcggtggcctcacgccagctctaccacgaacgccgggccgtggggcagggttccgaattcgccagcgggggcggcagcgagggcggccacacgatcccggtcgactacgtgagcctggccgagaagaccggacaggccgacgacccgcgcgtgcaggagatggccggtcgcgtcctggtgcaccgcgcggtggccgagcagctgatcggccacgtgtaccgcagcgtccgggacggcgcactgccgccggccgccggaacgctgatccggctgttccactccgaaaccgtcaccaccgacgtcgacaccgcgctggcgatcgcgggcagcgccggtgtggtcggggagccgggcgccggactggaaaccgggctgcgctacctgtcccggcagaccgtcgccatcggcggtggcacaacggaaatggcgcgcaacgtcatcggcgagcgggtgctgggcttcccccgggaatacgccgccgaccgcggggtgccgttcaaccaggtgcggcacgggcagcgctcggatcggtcctaaccttcggcgacgacgttctcggcgaggccgctgaccaccgggatctgcaccagcgacaggacgtggtgggccgggcttcccggcggggccaccagcacgtagtcgctgccttggcgcagcgcccgctcccgggcggcggccagcgcgctgacgcccgccgacccgaggtgggtgaccgcgctcagatcgaccgtcaaaggcgctacgccggaacggctttcgacggcgatctgccggtccagggtggacgcggtgttggagtcgacgtcgccgctgaccacgatgcggcccggctcggtgaccgtggagacgaattcggcgctgcgcaccccgtggtcgccggcccggctgaccagtgagtcggcgacgaaattggccgggcgcgaaagccggtgcgtcacacgggcggtcgtcccctcggggccgtgactgacgtgcgcctctgacaccagggcctcggccatggccaggcctcggccacggccggtctcgccttcccggtgatccttccaccgtccccggtcgatcaccgaggcgtgcaggttgccatcgccggccagcatcgcttcgacgaccacgccgtcgggaacctcggtggcgtagccgtgctcgaccgcgttctcgacgaactccgagatggcgtgcacgatgtcggagatgtcgtcggcgtcggcgccgacgtcggacaaccactgccgcaaccgggtgcgcaccgtgcgcgcggcgtgaatcgtcgcgtccagcgtcaagttcagtgggggtggcggtgtgcggcgttgcgccgcaagcagagtcacgtcgtcgctgtagccggtcgagcgcagcagcagctccagcgtctccgcgcagagccggtcggccgttcgcaccgacgattcgatgacgaagccgccctgaccggagacgatgttggcggccaggtccgcgaattcggcggtgctggctcccaagggccggcccggccgttcgatcaagccgtcggtgtagagcaggatcgagtcgcccacgtcgaggaattcggtgcggaccggaaagccggtgccgctgcccagcgggcccgcgccggacggctcgacgtagcgcgcggtcgcgtccgccgtgaccagcagcggcggcgggtgtccggctgtgcagtaactgaattccccgctgccgaagtccagcgagccgacgcacatggtggccgagctggaccccgggacgtgcttgtggaagcggtcgaccgcctcgagcgcttcggcgatcgggtatcccgccaggatctgcatccgcagcgcggtgcgcagctgggacatcaccgcggccgcttccaccccatggccgacgacgtcaccgacgatgagcaccaaccgatccccgagcgggatcgcatcgaaccagtcgccgccggccgcggtgtcctgcgcggccaccagatactccgcggtcacatccgcgccgggggtcaccggcaccgacggcgccagcagcgcctgctgcatgacggtggcggagtcgcgcacgttgcggtaccgctcggacagctcctcgaggcgcgcttcggcggccatccggttgcgcacccggtcggtgacgtcgacgaaggcgagctgcacgccctcgatcgagccgtcgtcgccgcggcgcggcgtgacgatgaaatcgaagaagtgctcctgggccttccccacgccttcgaagtcggcctgtacccgccattcggttcccgactgcggctcaccggtctggtaaacccggtcgaacatctggaagatttgctggctctccagctcgggatacacctcgcgggcgagcagcccgatcgggtcgaccggcggactgagcgcgcggtaggcggcgttgaccgcgacgaatcgatggtctggcccttccaggccgaccaacagcgcggggacgttgtcgaagacgcggcgcacgtcatcggccgcgccgacgattctgtcccagtccttttcggccaccatttggccctcctagcggtctccgtccggtgcgaccgtggcgaaaaccgggtcaatcgattgaccaatttgcacacgtagttgttcagattagcaatggttgccggcccggcattgcaacggctttgataccggcccgttaatcgtcgcccgattcgtcgacgcagcgcaattgacgccgccgaaaaacgctgctgtggactccctgaaagcgcgtttgcggatgtgacggtcgggtatgtcgctggcgtggccgatccgctggcacaaagcacgaagggcgcgaagggattgcggcggcgcctgctgtcgtcgcgggtactcaccctcaacggctgggtggcgttcaacctgccgcgcacggtgaccgcgctgggtggcgcgctgctgaccggactggtgctggtgcacatctacgtgctgaccaccgaaccgggtctgccgcgatatttcgctgcctacgtgctggggctgagcgcggcctgcgcgctggcggccggcgccatggtgttcgcgctcaaaccgattgtgccccagg
